(12) United States Patent
Paul et al.

(10) Patent No.: US 8,637,281 B2
(45) Date of Patent: Jan. 28, 2014

(54) ENHANCED DIHYDROXY-ACID DEHYDRATASE ACTIVITY IN LACTIC ACID BACTERIA

(75) Inventors: Brian James Paul, Wilmington, DE (US); Wonchul Suh, Hockessin, DE (US)

(73) Assignee: Butamax(TM) Advanced Biofuels LLC, Wilmington, DE (US)

(*) Notice: Subject to any disclaimer, the term of this patent is extended or adjusted under 35 U.S.C. 154(b) by 0 days.

(21) Appl. No.: 12/569,168

(22) Filed: Sep. 29, 2009

(65) Prior Publication Data

US 2010/0081183 A1 Apr. 1, 2010

Related U.S. Application Data

(60) Provisional application No. 61/100,810, filed on Sep. 29, 2008.

(51) Int. Cl.
| | | |
|---|---|---|
| *C12P 7/16* | (2006.01) | |
| *C12N 9/00* | (2006.01) | |
| *C12N 1/20* | (2006.01) | |
| *C12N 15/00* | (2006.01) | |
| *C07H 21/04* | (2006.01) | |

(52) U.S. Cl.
USPC ..... 435/160; 435/183; 435/252.3; 435/320.1; 536/23.1; 536/23.2

(58) Field of Classification Search
None
See application file for complete search history.

(56) References Cited

U.S. PATENT DOCUMENTS

| | | | |
|---|---|---|---|
| 4,683,202 | A | 7/1987 | Mullis |
| 5,643,779 | A | 7/1997 | Ehrlich et al. |
| 6,177,264 | B1 | 1/2001 | Eggeling et al. |
| 7,851,188 | B2 * | 12/2010 | Donaldson et al. ........... 435/160 |
| 8,241,878 | B2 | 8/2012 | Anthony et al. |
| 8,455,224 | B2 | 6/2013 | Paul et al. |
| 2007/0031918 | A1 | 2/2007 | Dunson, Jr. et al. |
| 2007/0092957 | A1 * | 4/2007 | Donaldson et al. ........... 435/157 |
| 2008/0261230 | A1 | 10/2008 | Liao et al. |
| 2009/0305363 | A1 | 12/2009 | Anthony et al. |
| 2010/0081154 | A1 | 4/2010 | Flint et al. |
| 2010/0081179 | A1 | 4/2010 | Anthony et al. |
| 2010/0081182 | A1 | 4/2010 | Paul et al. |

FOREIGN PATENT DOCUMENTS

WO WO2008098227 A2 8/2008

OTHER PUBLICATIONS

Neves et al. Eur J Biochem. Jun. 2000;267(12):3859-68.*
Accession Q8DRT7, published Apr. 4, 2003.*
Chica et al. Curr Opin Biotechnol. Aug. 2005;16(4):378-84.*
Cruz-Rodz et al., "High efficiency introduction of plasmid DNA into glycine treated *Enterococcus faecalis* by electroporation", Molecular Genetics and Genomics, 224:152-154 (1990).
Krogh, Anders et al., Hidden Markov Models in Computational Biology, Applications to Protein Modeling, J. Mol. Biol (1994) 235, 1501-1531, (1994).
International Search Report and Written Opinion for PCT/2009/058815, mailing date Jan. 13, 2010.
Flint et al., U.S. Appl. No. 12/569,636, filed Sep. 29, 2009.
Anthony et al., U.S. Appl. No. 12/569,069, filed Sep. 29, 2009.
Paul et al., U.S. Appl. No. 12/569,103, filed Sep. 29, 2009.
Paul et al., U.S. Appl. No. 12/569,136, filed Sep. 29, 2009.
Altschul, S. F., et al., "Basic Local Alignment Search Tool", J. Mol. Biol., 215:403 410 (1990).
Alegre et al., "Transformation of *Lactobacillus plantarum* by electroporation with in vitro modified plasmid DNA" FEMS Microbiology letters 241:73-77 (2004).
Arthur et al., "Contribution of VanY D,D-Carboxypeptidase to Glycopeptide Resistance in *Enterococcus faecalis* by Hydrolysis of Peptidoglycan Precursors", Antimicrob. Agents Chemother. 38:1899-1903 (1994).
Bringel, et al. "Optimized transformation by electroporation of *Lactobacillus plantarum* strains with plasmid vectors", Appl. Microbiol. Biotechnol. 33: 664-670 (1990).
Deshpande, Mukund V., "Ethanol Production from Cellulose by Coupled Saccharification/Fermentation using *Saccharomyces cerevisiae* and Cellulase Complex from *Sclerotium rolfsii* UV-8 Mutant", Appl. Biochem. Biotechnol., 36:227, (1992).
Durre, "New insights and novel developments in clostridial acetone/butanol/isopropanol fermenation", Appl. Microbiol. Biotechnol. 49:639-648 (1998).
Eichenbaum et al. "Use of the Lactococcal nisA Promoter to Regulate Gene Expression in Gram-Positive Bacteria: Comparison of Induction Level and Promoter Strength", Appl. Environ. Microbiol. 64(8):2763-2769 (1998).
Ferain et al."*Lactobacillus plantarum* IdhL gene: Overexpression and Deletion", J. Bact. 176:596 (1994).
Flint et al., "Dihydroxy Acid Dehydratase from Spinach Contains a [2Fe-2S] Cluster", J. Biol. Chem. (1988) 263:3558-64.
Frohman et al."Rapid production of full-length cDNAs from rare transcripts: Amplification using a single gene-specific oligonucleotide primer", PNAS USA 85:8998 (1988).
Fujimoto et al. "pAM401-Based Shuttle Vectors That Enable Overexpression of Promoterless Genes and one-Step Purification of Tag Fusion Proteins Directly from *Enterococcus faecalis*", Appl. Environ. Microbiol. 67:1262-1267 (2001).
Godon et al., "Branched-Chain Amino Acid Biosynthesis Genes in *Lactococcus lactis* subsp. lactis", J. Bacteriol. (1992) 174:6580-6589.
Groot et al., "Technologies for Butanol Recovery Integrated with Fermentations", Process. Biochem. 27:61-75 (1992).
Higgins and Sharp, "Fast and sensitive multiple sequence alignments on a microcomputer", CABIOS. 5:151-153 (1989).
Higgins, D.G. et al., "Clustal V: improved software for multiple sequence alignment", Comput. Appl. Biosci., 8:189-191 (1992).

(Continued)

*Primary Examiner* — Christian Fronda
(74) *Attorney, Agent, or Firm* — Christine M. Lhulier

(57) ABSTRACT

Lactic acid bacterial (LAB) cells were modified such that they have a specific activity of dihydroxy-acid dehydratase enzyme activity that is increased to about 0.1 μmol min$^{-1}$ mg$^{-1}$. LAB cells with even higher activities of 0.2 to 0.6 μmol min$^{-1}$ mg$^{-1}$ of DHAD activity were obtained.
These modified cells may be used to produce isobutanol when additional isobutanol biosynthetic pathway enzymes are expressed.

21 Claims, 1 Drawing Sheet

(56) References Cited

OTHER PUBLICATIONS

Figure 1:
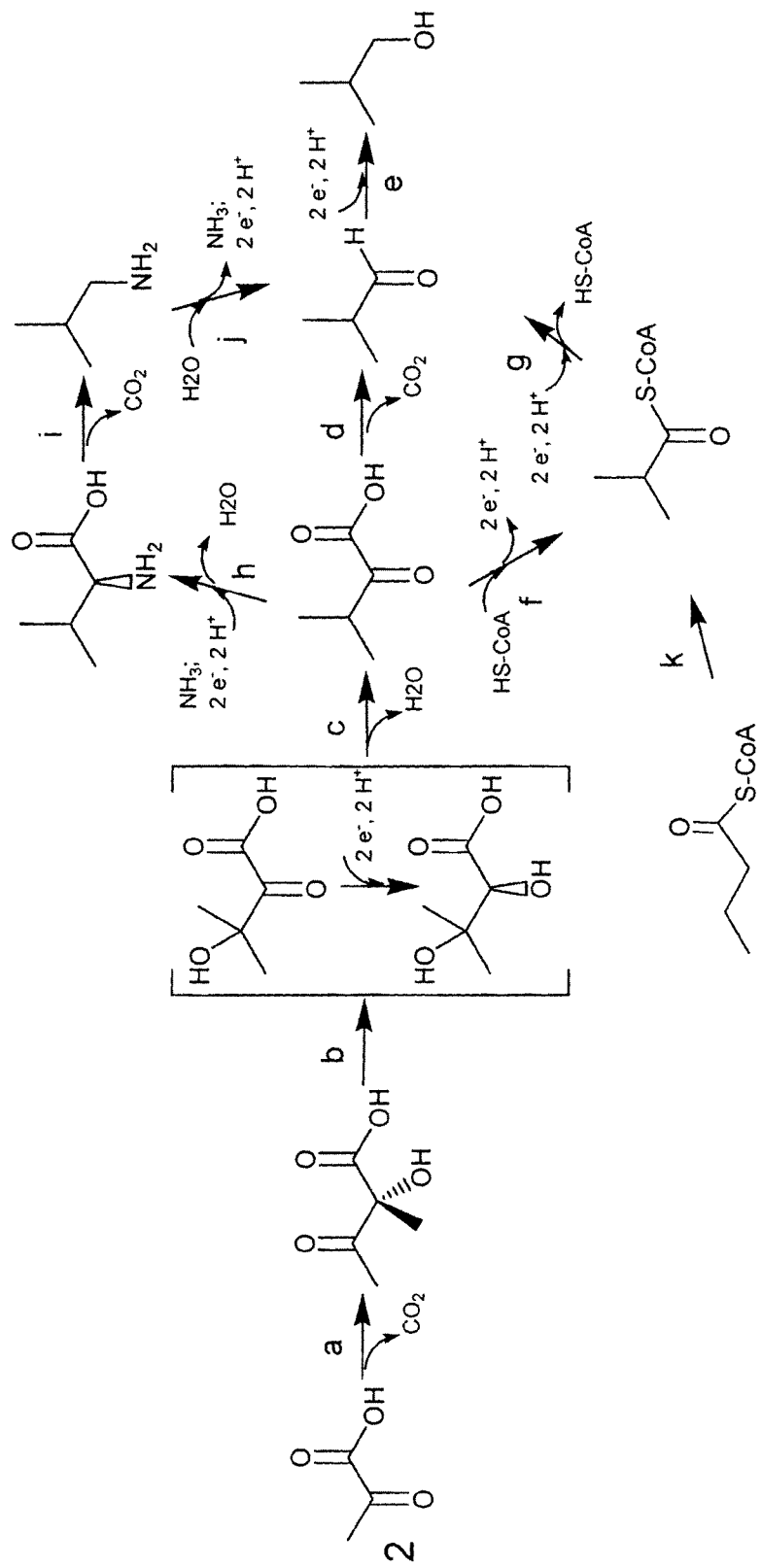

Hols et al., "Use of Homologous Expression-Secretion Signals and Vector-Free Stable Chromosomal Integration in Engineering of *Lactobacillus plantarum* for oL-Amylase and Levanase Expression", Appl. Environ. Microbiol. 60:1401-1403 (1994).

Horinouchi and Weisblum, "Nucleotide Sequence and Functional Map of pE194, a Plasmid That Specifies Inducible Resistance to Macrolide, Lincosamide, and Streptogramin Type B Antibiotics", J. Bacteriol. (1982) 150(2):804-814.

Jang et al.,"New integration vector using a cellulase gene as a screening marker for *Lactobacillus*", Micro. Lett. 24:191-195 (2003).

Kleerebezem et al., "Controlled Gene Expression Systems for Lactic Acid Bacteria: Transferable Nisin-Inducible Expression Cassettes for *Lactococcus, Leuconostoc*, and *Lactobacillus* spp.", Appl. Environ. Microbiol. 63:4581-4584 (1997).

Krogh et al., "Hidden Markov Models in Computational Biology", 1994; J. Mol. Biol. 235:1501-1531.

Loh et al., "Polymerase Chain Reaction with Single-Sided Specificity: Analysis of T Cell Receptor d Chain", Science 243:217 (1989).

Ohara et al., "One-sided polymerase chain reaction: The amplification of cDNA", PNAS USA 86:5673 (1989).

O'Sullivan et al., "High- and low-copy-number *Lactococcus* shuttle cloning vectors with features for clone screening", Gene 137:227-231 (1993).

Renault et al., "Plasmid vectors for Gram-positive bacteria switching from high to low copy number", Gene 183:175-182 (1996).

Rud et al., "A synthetic promoter library for constitutive gene expression in *Lactobacillus plantarum*", Microbiology 152:1011-1019 (2006).

Sørvig et al., "Plasmid p256 from *Lactobacillus plantarum* represents a new type of replicon in lactic acid bacteria, and contains a toxin-antitoxin-like plasmid maintenance system", Microbiology (2005) 151:421-431.

Shrago et al.,"Conjugal Plasmid Transfer (pAMb1) in *Lactobacillus plantarum*", Appl. Environ. Microbiol. 52:574-576 (1986).

Tabor, S. et al., "A bacteriophage T7 RNA polymerase/promoter system for controlled exclusive expression of specific genes", Proc. Acad. Sci. USA 82:1074 (1985).

Tanimoto et al., "Analysis of the Conjugal Transfer System of the Pheromone-Independent Highly Transferable *Enterococcus* Plasmid pMG1: Identification of a tra Gene (traA) Up-Regulated during Conjugation", J. Bacteriol. 184:5800-5804 (2002).

Thompson, J. D., et al., "Clustal W: improving the sensitivity of progressive multiple sequence alignment through sequence weighting, position-specific gap penalties and weight matrix choice", (1994) Nuc. Acid Res. 22: 4673-4680.

Van Ness and Chen, "The use of oligodeoxynucleotide probes in chaotrope-based hybridization solutions", Nucl. Acids Res. 19:5143 5151 (1991).

van Kranenburg et al., "Functional Analysis of Three Plasmids from *Lactobacillus plantarum*", Appl. Environ. Microbiol. Mar. 2005; 71(3): 1223-1230.

Walker, et al., "Isothermal in vitro amplification of DNA by a restriction enzyme/DNA polymerase system", Proc. Natl. Acad. Sci. U.S. A., 89:392 (1992).

Wyckoff et al., "Characterization and Sequence Analysis of a Stable Cryptic Plasmid from *Enterococcus faecium* 2226 and Development of a Stable Cloning Vector", Appl. Environ. Microbiol. 62:1481-1486 (1996).

Computational Molecular Biology (Lesk, A. M., Ed.) Oxford University: NY (1988).

Ausubel, F. M. et al., Current Protocols in Molecular Biology, Greene Publishing Assoc. And Wiley-Interscience, N.Y., 1987.

Biocomputing: Informatics and Genome Projects (Smith, D. W., Ed.) Academic: NY (1993).

Thomas D. Brock in Biotechnology: A Textbook of Industrial Microbiology, Second Edition (1989) Sinauer Associates, Inc., Sunderland, MA.

Computer Analysis of Sequence Data, Part I (Griffin, A. M., and Griffin, H. G., Eds.) Humania: NJ (1994).

Experiments in Molecular Genetics (Miller) Cold Spring Harbor Laboratory, 1972.

Experimental Techniques in Bacterial Genetics (Maloy, in Jones and Bartlett) 1990.

Thein et al., Human Genetic Diseases: A Practical Approach, K. E. Davis Ed., (1986) pp. 33-50, IRL: Herndon, VA.

Rychlik, W., In Methods in Molecular Biology, White, B. A. Ed., (1993) vol. 15, pp. 31 39, PCR Protocols: Current Methods and Applications. Humania: Totowa, NJ.

W. R. Pearson, Comput. Methods Genome Res., [Proc. Int. Symp.] (1994), Meeting Date 1992, 111 20. Editor(s): Suhai, Sandor. Plenum: New York, NY.

Sambrook, J., Fritsch, E. F. and Maniatis, T. Molecular Cloning: A Laboratory Manual, 2nd ed., Cold Spring Harbor Laboratory: Cold Spring Harbor, NY (1989).

Sequence Analysis in Molecular Biology (von Heinje, G., Ed.) Academic (1987).

Sequence Analysis Primer (Gribskov, M. and Devereux, J., Eds.) Stockton: NY (1991).

Silhavy, T. J., Bennan, M. L. and Enquist, L. W., Experiments with Gene Fusions, Cold Spring Harbor Laboratory Press, Cold Spring Harbor, NY (1984).

GenBank No. NC_004567.1, (2010).

GenBank No. AF508808, (2002).

"Dihydroxy-Acid Dehydratase" in *Springer Handbook of Enzymes*, vol. 4, Class 4, Lyases II, $2^{nd}$ Ed., Schomburg, D., et al., Eds., pp. 296-303, Springer-Verlag, Germany (2002).

Henriksen, C.M. and Nilsson, D., "Redirection of pyruvate catabolism in *Lactococcus Lactis* by selection of mutants with additional growth requirements", *Appl Microbiol Biotechnol* 56:767-775, Springer-Verlag, Germany (2001).

Johnson, D.C., et al., "Structure, Function, and Formation of Biological Iron-Sulfur Clusters", *Annu. Rev. Biochem.* 74:247-281, Annual Reviews, United States (2005).

* cited by examiner

ENHANCED DIHYDROXY-ACID DEHYDRATASE ACTIVITY IN LACTIC ACID BACTERIA

CROSS-REFERENCE TO RELATED APPLICATIONS

This application is related to and claims the benefit of priority of U.S. Provisional Application No. 61/100,810, filed Sep. 29, 2008, the entire contents of which is herein incorporated by reference.

FIELD OF THE INVENTION

The invention relates to the field of industrial microbiology and expression of dihydroxy-acid dehydratase activity. More specifically, increased levels of dihydroxy-acid dehydratase activity were achieved in lactic acid bacteria, allowing increased production of compounds from pathways including dihydroxy-acid dehydratase, such as isobutanol.

BACKGROUND OF THE INVENTION

Dihydroxy-acid dehydratase (DHAD), also called acetohydroxy acid dehydratase, catalyzes the conversion of 2,3-dihydroxyisovalerate to α-ketoisovalerate and of 2,3-dihydroxymethylvalerate to α-ketomethylvalerate. The DHAD enzyme requires binding of an iron-sulfur (Fe—S) cluster for activity, is classified as E.C. 4.2.1.9, and is part of naturally occurring biosynthetic pathways producing valine, isoleucine, leucine and pantothenic acid (vitamin B5). DHAD catalyzed conversion of 2,3-dihydroxyisovalerate to α-ketoisovalerate is also a common step in the multiple isobutanol biosynthetic pathways that are disclosed in commonly owned and co-pending US Patent Application Publication US 20070092957 A1. Disclosed therein is engineering of recombinant microorganisms for production of isobutanol. Isobutanol is useful as a fuel additive, whose availability may reduce the demand for petrochemical fuels.

High levels of DHAD activity are desired for increased production of products from biosynthetic pathways that include this enzyme activity, including for enhanced microbial production of branched chain amino acids, pantothenic acid, and isobutanol.

There is a need therefore to increase DHAD activity in lactic acid bacterial (LAB) cells to allow increased production of isobutanol and other products whose biosynthetic pathways include DHAD.

SUMMARY OF THE INVENTION

Provided herein is a recombinant lactic acid bacterial cell comprising at least one gene encoding a heterologous polypeptide having dihydroxy-acid dehydratase activity and wherein the bacterial cell is substantially free of lactate dehydrogenase activity. In some embodiments, the heterologous polypeptide having dihydroxy-acid dehydratase activity has a specific activity of at least about 0.1 μmol min$^{-1}$ mg$^{-1}$ total soluble protein in a crude cell extract. In other embodiments, the heterologous polypeptide having dihydroxy-acid dehydratase activity has a specific activity of at least about 0.6 μmol min$^{-1}$ mg$^{-1}$ total soluble protein in a crude cell extract.

In some embodiments, the dihydroxy-acid dehydratase enzyme is expressed by a nucleic acid molecule that is heterologous to the bacteria, and in some embodiments, the dihydroxy-acid dehydratase is a [2Fe-2S] dihydroxy-acid dehydratase. In some embodiments, the dihydroxy-acid dehydratase polypeptide has an amino acid sequence that matches the Profile HMM of table 7 with an E value of <10$^{-5}$ wherein the polypeptide additionally comprises all three conserved cysteines, corresponding to positions 56, 129, and 201 in the amino acids sequences of the *Streptococcus mutans* DHAD enzyme corresponding to SEQ ID NO:168.

In some embodiments, the dihydroxyacid dehydratase polypeptide has an amino acid sequence selected from the group consisting of SEQ ID NO:310, SEQ ID NO:298, SEQ ID NO:168, SEQ ID No:164, SEQ ID NO:346, SEQ ID NO:344, SEQ ID NO:232, and SEQ ID NO:230.

Also provided herein is a recombinant lactic acid bacterial cell comprising at least one gene encoding a heterologous polypeptide having dihydroxy-acid dehydratase activity wherein the bacterial cell is substantially free of lactate dehydrogenase activity and comprising a disruption in, or some other genetic modification that reduces expression of, at least one endogenous gene encoding a polypeptide having lactate dehydrogenase activity. In some embodiments, the gene encoding lactate dehydrogenase is selected from the group consisting of IdhL, IdhD, IdhL1, and IdhL2. In some embodiments, the lactic acid bacteria is selected from the group consisting of *Lactococcus, Lactobacillus, Leuconostoc, Oenococcus, Pediococcus*, and *Streptococcus*.

In some embodiments, the lactic acid host cell is *Lactobacillus plantarum* and the polypeptide having lactate dehydrogenase activity has an amino acid sequence selected from the group consisting of SEQ ID NO: 496, 498, and 500. In other embodiments, the lactic acid host cell is *Lactococcus lactis* and the polypeptide having lactate dehydrogenase activity has an amino acid sequence as set forth in SEQ ID NO:502. In other embodiments, the lactic acid host cell is *Leuconostoc mesenteroides* and the polypeptide having lactate dehydrogenase activity has an amino acid sequence as set forth in SEQ ID NO:504. In other embodiments, the lactic acid host cell is *Streptococcus thermophilus* and the polypeptide having lactate dehydrogenase activity has an amino acid sequence as set forth in SEQ ID NO:506. In other embodiments, the lactic acid host cell is *Pediococcus pentosaceus* and the polypeptide having lactate dehydrogenase activity has an amino acid sequence selected from the group consisting of SEQ ID NO:508 and 510. In other embodiments, the lactic acid host cell is *Lactobacillus acidophilus* and the polypeptide having lactate dehydrogenase activity has an amino acid sequence selected from the group consisting of SEQ ID NO:512, 514 and 516.

Also provided is a recombinant lactic acid bacterial cell comprising at least one gene encoding a heterologous polypeptide having dihydroxy-acid dehydratase activity wherein the bacterial cell is substantially free of lactate dehydrogenase activity and wherein the bacteria produces isobutanol. In some embodiments, the bacteria comprises an isobutanol biosynthetic pathway, and in some embodiments, the isobutanol biosynthetic pathway comprises genes encoding acetolactate synthase, acetohydroxy acid isomeroreductase, dihydroxy-acid dehydratase, branched-chain α-keto acid decarboxylase, and branched-chain alcohol dehydrogenase.

Also provided herein is a method of making isobutanol comprising providing the recombinant lactic acid bacteria described herein and growing the lactic acid bacteria under conditions wherein isobutanol is produced.

BRIEF DESCRIPTION OF THE FIGURES AND SEQUENCE DESCRIPTIONS

The various embodiments of the invention can be more fully understood from the following detailed description, the figures, and the accompanying sequence descriptions, which form a part of this application.

FIG. 1 shows biosynthetic pathways for biosynthesis of isobutanol.

Table 7 is a table of the Profile HMM for dihydroxy-acid dehydratases based on enzymes with assayed function. Table 7 is submitted herewith electronically and is incorporated herein by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

TABLE 1

SEQ ID NOs of representative bacterial [2Fe—2S] DHAD proteins and encoding sequences

| Organism of derivation | SEQ ID NO: Nucleic acid | SEQ ID NO: Peptide |
|---|---|---|
| Mycobacterium sp. MCS | 1 | 2 |
| Mycobacterium gilvum PYR-GCK | 3 | 4 |
| Mycobacterium smegmatis str. MC2 155 | 5 | 6 |
| Mycobacterium vanbaalenii PYR-1 | 7 | 8 |
| Nocardia farcinica IFM 10152 | 9 | 10 |
| Rhodococcus sp. RHA1 | 11 | 12 |
| Mycobacterium ulcerans Agy99 | 13 | 14 |
| Mycobacterium avium subsp. paratuberculosis K-10 | 15 | 16 |
| Mycobacterium tuberculosis H37Ra | 17 | 18 |
| Mycobacterium leprae TN * | 19 | 20 |
| Kineococcus radiotolerans SRS30216 | 21 | 22 |
| Janibacter sp. HTCC2649 | 23 | 24 |
| Nocardioides sp. JS614 | 25 | 26 |
| Renibacterium salmoninarum ATCC 33209 | 27 | 28 |
| Arthrobacter aurescens TC1 | 29 | 30 |
| Leifsonia xyli subsp. xyli str. CTCB07 | 31 | 32 |
| marine actinobacterium PHSC20C1 | 33 | 34 |
| Clavibacter michiganensis subsp. michiganensis NCPPB 382 | 35 | 36 |
| Saccharopolyspora erythraea NRRL 2338 | 37 | 38 |
| Acidothermus cellulolyticus 11B | 39 | 40 |
| Corynebacterium efficiens YS-314 | 41 | 42 |
| Brevibacterium linens BL2 | 43 | 44 |
| Tropheryma whipplei TW08/27 | 45 | 46 |
| Methylobacterium extorquens PA1 | 47 | 48 |
| Methylobacterium nodulans ORS 2060 | 49 | 50 |
| Rhodopseudomonas palustris BisB5 | 51 | 52 |
| Rhodopseudomonas palustris BisB18 | 53 | 54 |
| Bradyrhizobium sp. ORS278 | 55 | 56 |
| Bradyrhizobium japonicum USDA 110 | 57 | 58 |
| Fulvimarina pelagi HTCC2506 | 59 | 60 |
| Aurantimonas sp. SI85-9A1 | 61 | 62 |
| Hoeflea phototrophica DFL-43 | 63 | 64 |
| Mesorhizobium loti MAFF303099 | 65 | 66 |
| Mesorhizobium sp. BNC1 | 67 | 68 |
| Parvibaculum lavamentivorans DS-1 | 69 | 70 |
| Loktanella vestfoldensis SKA53 | 71 | 72 |
| Roseobacter sp. CCS2 | 73 | 74 |
| Dinoroseobacter shibae DFL 12 | 75 | 76 |
| Roseovarius nubinhibens ISM | 77 | 78 |
| Sagittula stellata E-37 | 79 | 80 |
| Roseobacter sp. AzwK-3b | 81 | 82 |
| Roseovarius sp. TM1035 | 83 | 84 |
| Oceanicola batsensis HTCC2597 | 85 | 86 |
| Oceanicola granulosus HTCC2516 | 87 | 88 |
| Rhodobacterales bacterium HTCC2150 | 89 | 90 |
| Paracoccus denitrificans PD1222 | 91 | 92 |

TABLE 1-continued

SEQ ID NOs of representative bacterial [2Fe—2S] DHAD proteins and encoding sequences

| Organism of derivation | SEQ ID NO: Nucleic acid | SEQ ID NO: Peptide |
|---|---|---|
| Oceanibulbus indolifex HEL-45 | 93 | 94 |
| Sulfitobacter sp. EE-36 | 95 | 96 |
| Roseobacter denitrificans OCh 114 | 97 | 98 |
| Jannaschia sp. CCS1 | 99 | 100 |
| Caulobacter sp. K31 | 101 | 102 |
| Candidatus Pelagibacter ubique HTCC1062 | 103 | 104 |
| Erythrobacter litoralis HTCC2594 | 105 | 106 |
| Erythrobacter sp. NAP1 | 107 | 108 |
| Comamonas testosterone KF-1 | 109 | 110 |
| Sphingomonas wittichii RW1 | 111 | 112 |
| Burkholderia xenovorans LB400 | 113 | 114 |
| Burkholderia phytofirmans PsJN | 115 | 116 |
| Bordetella petrii DSM 12804 | 117 | 118 |
| Bordetella bronchiseptica RB50 | 119 | 120 |
| Bradyrhizobium sp. ORS278 | 121 | 122 |
| Bradyrhizobium sp. BTAi1 | 123 | 124 |
| Bradhyrhizobium japonicum | 125 | 126 |
| Sphingomonas wittichii RW1 | 127 | 128 |
| Rhodobacterales bacterium HTCC2654 | 129 | 130 |
| Solibacter usitatus Ellin6076 | 131 | 132 |
| Roseiflexus sp. RS-1 | 133 | 134 |
| Rubrobacter xylanophilus DSM 9941 | 135 | 136 |
| Salinispora tropica CNB-440 | 137 | 138 |
| Acidobacteria bacterium Ellin345 | 139 | 140 |
| Thermus thermophilus HB27 | 141 | 142 |
| Maricaulis maris MCS10 | 143 | 144 |
| Parvularcula bermudensis HTCC2503 | 145 | 146 |
| Oceanicaulis alexandrii HTCC2633 | 147 | 148 |
| Plesiocystis pacifica SIR-1 | 149 | 150 |
| Bacillus sp. NRRL B-14911 | 151 | 152 |
| Oceanobacillus iheyensis HTE831 | 153 | 154 |
| Staphylococcus saprophyticus subsp. saprophyticus ATCC 15305 | 155 | 156 |
| Bacillus selenitireducens MLS10 | 157 | 158 |
| Streptococcus pneumoniae SP6-BS73 | 159 | 160 |
| Streptococcus sanguinis SK36 | 161 | 162 |
| Streptococcus thermophilus LMG 18311 | 163 | 164 |
| Streptococcus suis 89/1591 | 165 | 166 |
| Streptococcus mutans UA159 | 167 | 168 |
| Leptospira borgpetersenii serovar Hardjo-bovis L550 | 169 | 170 |
| Candidatus Vesicomyosocius okutanii HA | 171 | 172 |
| Candidatus Ruthia magnifica str. Cm (Calyptogena magnifica) | 173 | 174 |
| Methylococcus capsulatus str. Bath | 175 | 176 |
| uncultured marine bacterium EB80_02D08 | 177 | 178 |
| uncultured marine gamma proteobacterium EBAC31A08 | 179 | 180 |
| uncultured marine gamma proteobacterium EBAC20E09 | 181 | 182 |
| uncultured gamma proteobacterium eBACHOT4E07 | 183 | 184 |
| Alcanivorax borkumensis SK2 | 185 | 186 |
| Chromohalobacter salexigens DSM 3043 | 187 | 188 |
| Marinobacter algicola DG893 | 189 | 190 |
| Marinobacter aquaeolei VT8 | 191 | 192 |
| Marinobacter sp. ELB17 | 193 | 194 |
| Pseudoalteromonas haloplanktis TAC125 | 195 | 196 |
| Acinetobacter sp. ADP1 | 197 | 198 |
| Opitutaceae bacterium TAV2 | 199 | 200 |
| Flavobacterium sp. MED217 | 201 | 202 |
| Cellulophaga sp. MED134 | 203 | 204 |
| Kordia algicida OT-1 | 205 | 206 |
| Flavobacteriales bacterium ALC-1 | 207 | 208 |
| Psychroflexus torquis ATCC 700755 | 209 | 210 |
| Flavobacteriales bacterium HTCC2170 | 211 | 212 |
| unidentified eubacterium SCB49 | 213 | 214 |
| Gramella forsetii KT0803 | 215 | 216 |
| Robiginitalea biformata HTCC2501 | 217 | 218 |

TABLE 1-continued

SEQ ID NOs of representative bacterial [2Fe—2S] DHAD proteins and encoding sequences

| Organism of derivation | SEQ ID NO: Nucleic acid | SEQ ID NO: Peptide |
|---|---|---|
| Tenacibaculum sp. MED152 | 219 | 220 |
| Polaribacter irgensii 23-P | 221 | 222 |
| Pedobacter sp. BAL39 | 223 | 224 |
| Flavobacteria bacterium BAL38 | 225 | 226 |
| Flavobacterium psychrophilum JIP02/86 | 227 | 228 |
| Flavobacterium johnsoniae UW101 | 229 | 230 |
| Lactococcus lactis subsp. cremoris SK11 | 231 | 232 |
| Psychromonas ingrahamii 37 | 233 | 234 |
| Microscilla marina ATCC 23134 | 235 | 236 |
| Cytophaga hutchinsonii ATCC 33406 | 237 | 238 |
| Rhodopirellula baltica SH 1 | 239 | 240 |
| Blastopirellula marina DSM 3645 | 241 | 242 |
| Planctomyces maris DSM 8797 | 243 | 244 |
| Algoriphagus sp. PR1 | 245 | 246 |
| Candidatus Sulcia muelleri str. Hc (Homalodisca coagulata) | 247 | 248 |
| Candidatus Carsonella ruddii PV | 249 | 250 |
| Synechococcus sp. RS9916 | 251 | 252 |
| Synechococcus sp. WH 7803 | 253 | 254 |
| Synechococcus sp. CC9311 | 255 | 256 |
| Synechococcus sp. CC9605 | 257 | 258 |
| Synechococcus sp. WH 8102 | 259 | 260 |
| Synechococcus sp. BL107 | 261 | 262 |
| Synechococcus sp. RCC307 | 263 | 264 |
| Synechococcus sp. RS9917 | 265 | 266 |
| Synechococcus sp. WH 5701 | 267 | 268 |
| Prochlorococcus marinus str. MIT 9313 | 269 | 270 |
| Prochlorococcus marinus str. NATL2A | 271 | 272 |
| Prochlorococcus marinus str. MIT 9215 | 273 | 274 |
| Prochlorococcus marinus str. AS9601 | 275 | 276 |
| Prochlorococcus marinus str. MIT 9515 | 277 | 278 |
| Prochlorococcus marinus subsp. pastoris str. CCMP1986 | 279 | 280 |
| Prochlorococcus marinus str. MIT 9211 | 281 | 282 |
| Prochlorococcus marinus subsp. marinus str. CCMP1375 | 283 | 284 |
| Nodularia spumigena CCY9414 | 285 | 286 |
| Nostoc punctiforme PCC 73102 | 287 | 288 |
| Nostoc sp. PCC 7120 | 289 | 290 |
| Trichodesmium erythraeum IMS101 | 291 | 292 |
| Acaryochloris marina MBIC11017 | 293 | 294 |
| Lyngbya sp. PCC 8106 | 295 | 296 |
| Synechocystis sp. PCC 6803 | 297 | 298 |
| Cyanothece sp. CCY0110 | 299 | 300 |
| Thermosynechococcus elongatus BP-1 | 301 | 302 |
| Synechococcus sp. JA-2-3B'a(2-13) | 303 | 304 |
| Gloeobacter violaceus PCC 7421 | 305 | 306 |
| Nitrosomonas eutropha C91 | 307 | 308 |
| Nitrosomonas europaea ATCC 19718 | 309 | 310 |
| Nitrosospira multiformis ATCC 25196 | 311 | 312 |
| Chloroflexus aggregans DSM 9485 | 313 | 314 |
| Leptospirillum sp. Group II UBA | 315 | 316 |
| Leptospirillum sp. Group II UBA | 317 | 318 |
| Halorhodospira halophila SL1 | 319 | 320 |
| Nitrococcus mobilis Nb-231 | 321 | 322 |
| Alkalilimnicola ehrlichei MLHE-1 | 323 | 324 |
| Deinococcus geothermalis DSM 11300 | 325 | 326 |
| Polynucleobacter sp. QLW-P1DMWA-1 | 327 | 328 |
| Polynucleobacter necessarius STIR1 | 329 | 330 |
| Azoarcus sp. EbN1 | 331 | 332 |
| Burkholderia phymatum STM815 | 333 | 334 |
| Burkholderia xenovorans LB400 | 335 | 336 |
| Burkholderia multivorans ATCC 17616 | 337 | 338 |
| Burkholderia cenocepacia PC184 | 339 | 340 |
| Burkholderia mallei GB8 horse 4 | 341 | 342 |
| Ralstonia eutropha JMP134 | 343 | 344 |
| Ralstonia metallidurans CH34 | 345 | 346 |
| Ralstonia solanacearum UW551 | 347 | 348 |
| Ralstonia pickettii 12J | 349 | 350 |
| Limnobacter sp. MED105 | 351 | 352 |
| Herminiimonas arsenicoxydans | 353 | 354 |
| Bordetella parapertussis | 355 | 356 |
| Bordetella petrii DSM 12804 | 357 | 358 |
| Polaromonas sp. JS666 | 359 | 360 |
| Polaromonas naphthalenivorans CJ2 | 361 | 362 |
| Rhodoferax ferrireducens T118 | 363 | 364 |
| Verminephrobacter eiseniae EF01-2 | 365 | 366 |
| Acidovorax sp. JS42 | 367 | 368 |
| Delftia acidovorans SPH-1 | 369 | 370 |
| Methylibium petroleiphilum PM1 | 371 | 372 |
| gamma proteobacterium KT 71 | 373 | 374 |
| Tremblaya princeps | 375 | 376 |
| Blastopirellula marina DSM 3645 | 377 | 378 |
| Planctomyces maris DSM 8797 | 379 | 380 |
| Microcystis aeruginosa PCC 7806 | 381 | 382 |
| Salinibacter ruber DSM 13855 | 383 | 384 |
| Methylobacterium chloromethanicum | 385 | 386 |

TABLE 2

SEQ ID NOs of representative fungal and plant [2Fe—2S] DHAD proteins and encoding sequences

| Description | SEQ ID NO: Nucleic acid | SEQ ID NO: Peptide |
|---|---|---|
| Schizosaccharomyces pombe ILV3 | 387 | 388 |
| Saccharomyces cerevisiae ILV3 | 389 | 390 |
| Kluyveromyces lactis ILV3 | 391 | 392 |
| Candida albicans SC5314 ILV3 | 393 | 394 |
| Pichia stipitis CBS 6054 ILV3 | 395 | 396 |
| Yarrowia lipolytica ILV3 | 397 | 398 |
| Candida galbrata CBS 138 ILV3 | 399 | 400 |
| Chlamydomonas reinhardtii | 401 | 402 |
| Ostreococcus lucimarinus CCE9901 | 403 | 404 |
| Vitis vinifera (Unnamed protein product: CAO71581.1) | 405 | 406 |
| Vitis vinifera (Hypothetical protein: CAN67446.1) | 407 | 408 |
| Arabidopsis thaliana | 409 | 410 |
| Oryza sativa (indica cultivar-group) | 411 | 412 |
| Physcomitrella patens subsp. Patens | 413 | 414 |
| Chaetomium globosum CBS 148.51 | 415 | 416 |
| Neurospora crassa OR74A | 417 | 418 |
| Magnaporthe grisea 70-15 | 419 | 420 |
| Gibberella zeae PH-1 | 421 | 422 |
| Aspergillus niger | 423 | 424 |
| Neosartorya fischeri NRRL 181 (XP_001266525.1) | 425 | 426 |
| Neosartorya fischeri NRRL 181 (XP_001262996.1) | 427 | 428 |
| Aspergillus niger (hypothetical protein An03g04520) | 429 | 430 |
| Aspergillus niger (Hypothetical protein An14g03280) | 431 | 432 |
| Aspergillus terreus NIH2624 | 433 | 434 |
| Aspergillus clavatus NRRL 1 | 435 | 436 |
| Aspergillus nidulans FGSC A4 | 437 | 438 |
| Aspergillus oryzae | 439 | 440 |
| Ajellomyces capsulatus NAm1 | 441 | 442 |
| Coccidioides immitis RS | 443 | 444 |
| Botryotinia fuckeliana B05.10 | 445 | 446 |
| Phaeosphaeria nodorum SN15 | 447 | 448 |
| Pichia guilliermondii ATCC 6260 | 449 | 450 |
| Debaryomyces hansenii CBS767 | 451 | 452 |
| Lodderomyces elongisporus NRRL YB-4239 | 453 | 454 |
| Vanderwaltozyma polyspora DSM 70294 | 455 | 456 |
| Ashbya gossypii ATCC 10895 | 457 | 458 |
| Laccaria bicolor S238N-H82 | 459 | 460 |
| Coprinopsis cinerea okayama 7#130 | 461 | 462 |
| Cryptococcus neoformans var. neoformans JEC21 | 463 | 464 |

TABLE 2-continued

SEQ ID NOs of representative fungal and plant [2Fe—2S] DHAD proteins and encoding sequences

| Description | SEQ ID NO: Nucleic acid | SEQ ID NO: Peptide |
|---|---|---|
| Ustilago maydis 521 | 465 | 466 |
| Malassezia globosa CBS 7966 | 467 | 468 |
| Aspergillus clavatus NRRL 1 | 469 | 470 |
| Neosartorya fischeri NRRL 181 (Putative) | 471 | 472 |
| Aspergillus oryzae | 473 | 474 |
| Aspergillus niger (hypothetical protein An18g04160) | 475 | 476 |
| Aspergillus terreus NIH2624 | 477 | 478 |
| Coccidioides immitis RS (hypothetical protein CIMG_04591) | 479 | 480 |
| Paracoccidioides brasiliensis | 481 | 482 |
| Phaeosphaeria nodorum SN15 | 483 | 484 |
| Gibberella zeae PH-1 | 485 | 486 |
| Neurospora crassa OR74A | 487 | 488 |
| Coprinopsis cinerea okayama 7#130 | 489 | 490 |
| Laccaria bicolor S238N-H82 | 491 | 492 |
| Ustilago maydis 521 | 493 | 494 |

TABLE 3

SEQ ID NOs of representative [4Fe—4S] 2+ DHAD proteins and encoding sequences

| Organism | SEQ ID NO: Nucleic Acid | SEQ ID NO: Peptide |
|---|---|---|
| Escherichia coli str. K-12 substr. MG1655 | 525 | 526 |
| Bacillus subtilis subsp. subtilis str. 168 | 527 | 528 |
| Agrobacterium tumefaciens str. C58 | 529 | 530 |
| Burkholderia cenocepacia MC0-3 | 531 | 532 |
| Psychrobacter cryohalolentis K5 | 533 | 534 |
| Psychromonas sp. CNPT3 | 535 | 536 |
| Deinococcus radiodurans R1 | 537 | 538 |
| Wolinella succinogenes DSM 1740 | 539 | 540 |
| Zymomonas mobilis subsp. mobilis ZM4 | 541 | 542 |
| Clostridium acetobutylicum ATCC 824 | 543 | 544 |
| Clostridium beijerinckii NCIMB 8052 | 545 | 546 |
| Pseudomonas fluorescens Pf-5 | 547 | 548 |
| Methanococcus maripaludis C7 | 549 | 550 |
| Methanococcus aeolicus Nankai-3 | 551 | 552 |
| Vibrio fischeri ATCC 700601 (ES114) | 553 | 554 |
| Shewanella oneidensis MR-1 ATCC 700550 | 555 | 556 |

TABLE 4

SEQ ID NOs of representative lactate dehydrogenase proteins and encoding sequences

| Organism and gene name | SEQ ID NO: nucleic acid | SEQ ID NO: amino acid |
|---|---|---|
| Lactobacillus plantarum ldhD | 495 | 496 |
| Lactobacillus plantarum ldhL1 | 497 | 498 |
| Lactobacillus plantarum ldhL2 | 499 | 500 |
| Lactococcus lactis ldhL | 501 | 502 |
| Leuconostoc mesenteroides ldhD | 503 | 504 |
| Streptococcus thermophilus ldhL | 505 | 506 |
| Pediococcus pentosaceus ldhD | 507 | 508 |
| Pediococcus pentosaceus ldhL | 509 | 510 |
| Lactobacillus acidophilus ldhL1 | 511 | 512 |
| Lactobacillus acidophilus ldhL2 | 513 | 514 |
| Lactobacillus acidophilus ldhD | 515 | 516 |

TABLE 5

SEQ ID NOs of additional proteins and encoding sequences

| Description | SEQ ID NO: Encoding seq | SEQ ID NO: Protein |
|---|---|---|
| Vibrio cholerae KARI | 517 | 518 |
| Pseudomonas aeruginosa PAO1 KARI | 523 | 524 |
| Pseudomonas fluorescens PF5 KARI | 519 | 520 |
| Achromobacter xylosoxidans butanol dehydrogenase sadB | 521 | 522 |
| Lactobacillus plantarum orotidine-5'-phosphate decarboxylase, pyrF | 571 | — |

TABLE 6

SEQ ID NOs of primers and vectors

| Name | Description | SEQ ID NO: |
|---|---|---|
| 3T-ilvDLI(BamHI) | ilvD (L. lactis) forward primer | 557 |
| 5B-ilvDLI(NotI) | ilvD (L. lactis) reverse primer | 558 |
| F-primer | ilvD (S. mutans) forward primer | 559 |
| R-primer | ilvD (S. mutans) reverse primer | 560 |
| pET28a-F(NotI) | pET28a forward primer | 561 |
| pET28a-R(NheI) | pET28a reverse primer | 562 |
| pDM1 vector | Vector | 563 |
| pFP996 | Vector | 565 |
| oBP120 | Primer | 567 |
| oBP182 | Primer | 568 |
| oBP190 | Primer | 569 |
| oBP192 | Primer | 570 |
| Top D F1 | Primer | 572 |
| Top D R1 | Primer | 573 |
| Bot D F2 | Primer | 574 |
| Bot D R2 | Primer | 575 |
| ldhD Seq F1 | Primer | 576 |
| D check R | Primer | 577 |
| D check F3 | Primer | 578 |
| oBP31 | Primer | 579 |
| oBP32 | Primer | 580 |
| oBP33 | Primer | 581 |
| oBP34 | Primer | 582 |
| oBP42 | Primer | 584 |
| oBP49 | Primer | 583 |
| oBP56 | Primer | 585 |
| oBP57 | Primer | 586 |

SEQ ID NO:564 is the nucleotide sequence of the Lactococcus lactis subsp lactis NCDO2118 ilvD coding region.

SEQ ID NO:566 is the nucleotide sequence of a ribosome binding site.

DETAILED DESCRIPTION OF THE INVENTION

Provided herein is a recombinant lactic acid bacterial cell comprising at least one gene encoding a heterologous polypeptide having dihydroxy-acid dehydratase activity and wherein the bacterial cell is substantially free of lactate dehydrogenase activity. Further disclosed herein is the discovery that the specific activity of Fe—S requiring DHAD is increased in lactic acid bacterial hosts that are substantially free of lactate dehydrogenase activity.

The recombinant lactic acid bacterial (LAB) cells described herein have been engineered to have increased dihydroxy-acid dehydratase (DHAD) activity. In one embodiment, the engineered LAB cells have at least about 0.1 µmol min$^{-1}$ mg$^{-1}$ of DHAD activity as measured for specific activity. LAB cells with this level of DHAD activity are useful for production of compounds in biochemical pathways including DHAD, such as valine, isoleucine, leucine, pantothenic acid (vitamin B5), and isobutanol. In addition, the present invention relates to a method for producing isobutanol using the present engineered LAB cells with increased DHAD activity. Production of isobutanol in lactic acid bacteria will reduce the need for petrochemicals through use of isobutanol as a fuel additive.

The following abbreviations and definitions will be used for the interpretation of the specification and the claims.

As used herein, the terms "comprises," "comprising," "includes," "including," "has," "having," "contains" or "containing," or any other variation thereof, are intended to cover a non-exclusive inclusion. For example, a composition, a mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances (i.e. occurrences) of the element or component. Therefore "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the specification and the claims.

As used herein, the term "about" modifying the quantity of an ingredient or reactant of the invention employed refers to variation in the numerical quantity that can occur, for example, through typical measuring and liquid handling procedures used for making concentrates or use solutions in the real world; through inadvertent error in these procedures; through differences in the manufacture, source, or purity of the ingredients employed to make the compositions or carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, preferably within 5% of the reported numerical value.

The term "isobutanol biosynthetic pathway" refers to an enzyme pathway to produce isobutanol from pyruvate.

The term "lactate dehydrogenase" refers to a polypeptide (or polypeptides) having an enzyme activity that catalyzes the conversion of pyruvate to lactate. Lactate dehydrogenases are known as EC 1.1.1.27 (L-lactate dehydrogenase) or EC 1.1.1.28 (D-lactate dehydrogenase), and are further characterized herein.

The term "substantially free" when used in reference to the presence or absence of lactate dehydrogenase enzyme activity means that the level of the enzyme activity is substantially less than that of the same enzyme in the wild-type host, where less than 50% of the wild-type level is preferred and less than about 90% of the wild-type level is most preferred. The reduced level of enzyme activity may be attributable to genetic modification genes encoding this enzyme such that expression levels of the enzyme are reduced.

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. "Heterologous gene" includes a native coding region, or portion thereof, that is reintroduced into the source organism in a form that is different from the corresponding native gene. For example, a heterologous gene may include a native coding region that is a portion of a chimeric gene including non-native regulatory regions that is reintroduced into the native host. Also a foreign gene can comprise native genes inserted into a non-native organism, or chimeric genes. A "transgene" is a gene that has been introduced into the genome by a transformation procedure.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein, refer to an extra chromosomal element often carrying genes which are not part of the central metabolism of the cell, and usually in the form of circular double-stranded DNA molecules. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

As used herein, an "isolated nucleic acid fragment" or "isolated nucleic acid molecule" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual, 2$^{nd}$ ed.*, Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: N.J. (1994); 4.) *Sequence Analysis in . Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191(1992), Thompson, J. D., Higgins, D. G., and Gibson T. J. (1994) *Nuc. Acid Res.* 22: 4673 4680) and found in the MegAlign™ v 6.1 program of the LASERGENE bioinformatics computing suite (DNASTAR Inc.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, from other species, wherein such polypeptides have the same or similar function or activity. Useful examples of percent identities include, but are not limited to: 24%, 30%, 35%, 40%, 45%, 50%, 55%, 60%, 65%, 70%, 75%, 80%, 85%, 90%, or 95%, or any integer percentage from 24% to 100% may be useful in describing the present invention, such as 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.](1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual,* Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions,* Cold Spring Harbor Laboratory Press, Cold Spring Harbor, N.Y. (1984); and by Ausubel, F. M. et al., *Current Protocols in Molecular Biology,* published by Greene Publishing Assoc. and Wiley-Interscience (1987).

The invention relates to the engineering of a lactic acid bacterial cell such that the cell is substantially free of lactic acid dehydrogenase (LDH) activity and has DHAD activity. Surprisingly, it was found that expression of the Fe—S cluster requiring DHAD enzyme in a host cell substantially lacking LDH activity resulted in increased specific activity as compared to the activity of the same DHAD enzyme when expressed in a host containing LDH activity.

DHAD Activity

Lactic acid bacteria cells substantially free of lactic acid dehydrogenase and expressing DHAD enzymes having a specific activity level of at least about 0.1 µmol min$^{-1}$ mg$^{-1}$ where mg is the amount of total soluble protein in a crude cell extract. In addition, DHAD specific activities of at least about 0.2 µmol min$^{-1}$ mg$^{-1}$, and of at least about 0.4 µmol min$^{-1}$ mg$^{-1}$ may be achieved in LAB cells, where specific activities of at least about 0.6 µmol min$^{-1}$ mg$^{-1}$ are reasonably expected. Disclosed herein are LAB cells having these levels of DHAD activity.

In the disclosed LAB cells, any gene encoding a DHAD enzyme may be used to provide expression of DHAD activity in a LAB cell. DHAD, also called acetohydroxy acid dehydratase, catalyzes the conversion of 2,3-dihydroxyisovalerate to α-ketoisovalerate and of 2,3-dihydroxymethylvalerate to α-ketomethylvalerate and is classified as E.C. 4.2.1.9. Coding sequences for DHADs that may be used herein may be derived from bacterial, fungal, or plant sources. DHADs that may be used may have a [4Fe-4S] cluster or a [2Fe-2S] cluster bound by the apoprotein. Tables 1, 2, and 3 list SEQ ID NOs for coding regions and proteins of representative DHADs that may be used in the present invention. Proteins with at least about 95% identity to those listed sequences have been omitted for simplification, but it is understood that the omitted proteins with at least about 95% sequence identity to any of the proteins listed in Tables 1, 2, and 3 and having DHAD activity may be used as disclosed herein. Additional DHAD proteins and their encoding sequences may be identified by BLAST searching of public databases, as well known to one skilled in the art. Typically BLAST (described above) searching of publicly available databases with known DHAD sequences, such as those provided herein, is used to identify DHADs and their encoding sequences that may be expressed in the present cells. For example, DHAD proteins having amino acid sequence identities of at least about 80-85%, 85%-90%, 90%-95% or 98% sequence identity to any of the DHAD proteins of Table 1 may be expressed in the present cells.

Identities are based on the Clustal W method of alignment using the default parameters of GAP PENALTY=10, GAP LENGTH PENALTY=0.1, and Gonnet 250 series of protein weight matrix over the full length of the protein sequence.

Additional [2Fe-2S] DHADs may be identified using the analysis described in co-pending U.S. Patent Application 61/100,792, which is herein incorporated by reference. The analysis is as follows: A Profile Hidden Markov Model (HMM) was prepared based on amino acid sequences of eight functionally verified DHADs. These DHADs are from *Nitrosomonas europaea* (DNA SEQ ID NO:309; protein SEQ ID NO:310), *Synechocystis* sp. PCC6803 (DNA SEQ ID:297; protein SEQ ID NO:298), *Streptococcus mutans* (DNA SEQ ID NO:167; protein SEQ ID NO:168), *Streptococcus thermophilus* (DNA SEQ ID NO:163; SEQ ID No:164), *Ralstonia metallidurans* (DNA SEQ ID NO:345; protein SEQ ID NO:346), *Ralstonia eutropha* (DNA SEQ ID NO:343; protein SEQ ID NO:344), and *Lactococcus lactis* (DNA SEQ ID NO:231; protein SEQ ID NO:232). In addition the DHAD from *Flavobacterium johnsoniae* (DNA SEQ ID NO:229; protein SEQ ID NO:230) was found to have dihydroxy-acid dehydratase activity when expressed in *E. coli* and was used in making the Profile. The Profile HMM is prepared using the HMMER software package (The theory behind profile HMMs is described in R. Durbin, S. Eddy, A. Krogh, and G. Mitchison, *Biological sequence analysis: probabilistic models of proteins and nucleic acids*, Cambridge University Press, 1998; Krogh et al., 1994; J. Mol. Biol. 235:1501-1531), following the user guide which is available from HMMER (Janelia Farm Research Campus, Ashburn, Va.). The output of the HMMER software program is a Profile Hidden Markov Model (HMM) that characterizes the input sequences. The Profile HMM prepared for the eight DHAD proteins is given in Table 7. Any protein that matches the Profile HMM with an E value of <10$^{-5}$ is a DHAD related protein, which includes [4Fe-4S] DHADs, [2Fe-2S] DHADs, aldonic acid dehydratases, and phosphogluconate dehydratases. Sequences matching the Profile HMM are then analyzed for the presence of the three conserved cysteines, corresponding to positions 56, 129, and 201 in the *Streptococcus mutans* DHAD. The presence of all three conserved cysteines is characteristic of proteins having a [2Fe-2S] cluster. Proteins having the three conserved cysteines include arabonate dehydratases and [2Fe-2S] DHADs and are members of a [2Fe-2S] DHAD/aldonic acid dehydratase group. The [2Fe-2S] DHADs may be distinguished from the aldonic acid dehydratases by analyzing for signature conserved amino acids found to be present in the [2Fe-2S] DHADs or in the aldonic acid dehydratases at positions corresponding to the following positions in the *Streptococcus mutans* DHAD amino acid sequence. These signature amino acids are in [2Fe-2S] DHADs or in aldonic acid dehydratases, respectively, at the following positions (with greater than 90% occurance): 88 asparagine vs glutamic acid; 113 not conserved vs glutamic acid; 142 arginine or asparagine vs not conserved; 165: not conserved vs glycine; 208 asparagine vs not conserved; 454 leucine vs not conserved; 477 phenylalanine or tyrosine vs not conserved; and 487 glycine vs not conserved.

Additionally, the sequences of DHAD coding regions provided herein may be used to identify other homologs in nature. For example each of the DHAD encoding nucleic acid fragments described herein may be used to isolate genes encoding homologous proteins. Isolation of homologous genes using sequence-dependent protocols is well known in the art. Examples of sequence-dependent protocols include, but are not limited to: 1.) methods of nucleic acid hybridization; 2.) methods of DNA and RNA amplification, as exemplified by various uses of nucleic acid amplification technologies [e.g., polymerase chain reaction (PCR), Mullis et al., U.S. Pat. No. 4,683,202; ligase chain reaction (LCR), Tabor, S. et al., *Proc. Acad. Sci.* USA 82:1074 (1985); or strand displacement amplification (SDA), Walker, et al., *Proc. Natl. Acad. Sci. U.S.A.,* 89:392 (1992)]; and 3.) methods of library construction and screening by complementation.

For example, genes encoding similar proteins or polypeptides to the DHAD encoding genes provided herein could be isolated directly by using all or a portion of the instant nucleic acid fragments as DNA hybridization probes to screen libraries from any desired organism using methodology well known to those skilled in the art. Specific oligonucleotide probes based upon the disclosed nucleic acid sequences can be designed and synthesized by methods known in the art (Maniatis, supra). Moreover, the entire sequences can be used directly to synthesize DNA probes by methods known to the skilled artisan (e.g., random primers DNA labeling, nick translation or end-labeling techniques), or RNA probes using available in vitro transcription systems. In addition, specific primers can be designed and used to amplify a part of (or full-length of) the instant sequences. The resulting amplification products can be labeled directly during amplification reactions or labeled after amplification reactions, and used as probes to isolate full-length DNA fragments by hybridization under conditions of appropriate stringency.

Typically, in PCR-type amplification techniques, the primers have different sequences and are not complementary to each other. Depending on the desired test conditions, the sequences of the primers should be designed to provide for both efficient and faithful replication of the target nucleic acid. Methods of PCR primer design are common and well known in the art (Thein and Wallace, "The use of oligonucleotides as specific hybridization probes in the Diagnosis of Genetic Disorders", in *Human Genetic Diseases: A Practical Approach*, K. E. Davis Ed., (1986) pp 33-50, IRL: Herndon, Va.; and Rychlik, W., In *Methods in Molecular Biology*, White, B. A. Ed., (1993) Vol. 15, pp 31-39, PCR Protocols: Current Methods and Applications. Humania: Totowa, N.J.).

Generally two short segments of the described sequences may be used in polymerase chain reaction protocols to amplify longer nucleic acid fragments encoding homologous genes from DNA or RNA. The polymerase chain reaction may also be performed on a library of cloned nucleic acid fragments wherein the sequence of one primer is derived from the described nucleic acid fragments, and the sequence of the other primer takes advantage of the presence of the polyadenylic acid tracts to the 3' end of the mRNA precursor encoding microbial genes.

Alternatively, the second primer sequence may be based upon sequences derived from the cloning vector. For example, the skilled artisan can follow the RACE protocol (Frohman et al., *PNAS USA* 85:8998 (1988)) to generate cDNAs by using PCR to amplify copies of the region between a single point in the transcript and the 3' or 5' end. Primers oriented in the 3' and 5' directions can be designed from the instant sequences. Using commercially available 3' RACE or 5' RACE systems (e.g., BRL, Gaithersburg, Md.), specific 3' or 5' cDNA fragments can be isolated (Ohara et al., *PNAS USA* 86:5673 (1989); Loh et al., *Science* 243:217 (1989)).

Alternatively, the provided DHAD encoding sequences may be employed as hybridization reagents for the identification of homologs. The basic components of a nucleic acid hybridization test include a probe, a sample suspected of containing the gene or gene fragment of interest, and a specific hybridization method. Probes are typically single-stranded nucleic acid sequences that are complementary to the nucleic acid sequences to be detected. Probes are "hybridizable" to the nucleic acid sequence to be detected. The probe length can vary from 5 bases to tens of thousands of bases, and will depend upon the specific test to be done. Typically a probe length of about 15 bases to about 30 bases is suitable. Only part of the probe molecule need be complementary to the nucleic acid sequence to be detected. In addition, the complementarity between the probe and the target sequence need not be perfect. Hybridization does occur between imperfectly complementary molecules with the result that a certain fraction of the bases in the hybridized region are not paired with the proper complementary base.

Hybridization methods are well defined. Typically the probe and sample must be mixed under conditions that will permit nucleic acid hybridization. This involves contacting the probe and sample in the presence of an inorganic or organic salt under the proper concentration and temperature conditions. The probe and sample nucleic acids must be in contact for a long enough time that any possible hybridization between the probe and sample nucleic acid may occur. The concentration of probe or target in the mixture will determine the time necessary for hybridization to occur. The higher the probe or target concentration, the shorter the hybridization incubation time needed. Optionally, a chaotropic agent may be added. The chaotropic agent stabilizes nucleic acids by inhibiting nuclease activity. Furthermore, the chaotropic agent allows sensitive and stringent hybridization of short oligonucleotide probes at room temperature (Van Ness and Chen, *Nucl. Acids Res.* 19:5143-5151 (1991)). Suitable chaotropic agents include guanidinium chloride, guanidinium thiocyanate, sodium thiocyanate, lithium tetrachloroacetate, sodium perchlorate, rubidium tetrachloroacetate, potassium iodide and cesium trifluoroacetate, among others. Typically, the chaotropic agent will be present at a final concentration of about 3 M. If desired, one can add formamide to the hybridization mixture, typically 30-50% (v/v).

Various hybridization solutions can be employed. Typically, these comprise from about 20 to 60% volume, preferably 30%, of a polar organic solvent. A common hybridization solution employs about 30-50% v/v formamide, about 0.15 to 1 M sodium chloride, about 0.05 to 0.1 M buffers (e.g., sodium citrate, Tris-HCl, PIPES or HEPES (pH range about 6-9)), about 0.05 to 0.2% detergent (e.g., sodium dodecylsulfate), or between 0.5-20 mM EDTA, FICOLL (Pharmacia Inc.) (about 300-500 kdal), polyvinylpyrrolidone (about 250-500 kdal) and serum albumin. Also included in the typical hybridization solution will be unlabeled carrier nucleic acids from about 0.1 to 5 mg/mL, fragmented nucleic DNA (e.g., calf thymus or salmon sperm DNA, or yeast RNA), and optionally from about 0.5 to 2% wt/vol glycine. Other additives may also be included, such as volume exclusion agents that include a variety of polar water-soluble or swellable agents (e.g., polyethylene glycol), anionic polymers (e.g., polyacrylate or polymethylacrylate) and anionic saccharidic polymers (e.g., dextran sulfate).

Nucleic acid hybridization is adaptable to a variety of assay formats. One of the most suitable is the sandwich assay format. The sandwich assay is particularly adaptable to hybridization under non-denaturing conditions. A primary component of a sandwich-type assay is a solid support. The solid support has adsorbed to it or covalently coupled to it immobilized nucleic acid probe that is unlabeled and complementary to one portion of the sequence.

Genetic Modification for Expression of DHAD Activity

LAB cells that may be engineered to create cells of the present invention include, but are not limited to, *Lactococcus, Lactobacillus, Leuconostoc, Oenococcus, Pediococcus,* and *Streptococcus.*

LAB cells are genetically modified for expression of DHAD activity using methods well known to one skilled in the art. Expression of DHAD is generally achieved by transforming suitable LAB host cells with a sequence encoding a DHAD protein. Typically the coding sequence is part of a chimeric gene used for transformation, which includes a promoter operably linked to the coding sequence as well as a ribosome binding site and a termination control region. The coding region may be from the host cell for transformation and combined with regulatory sequences that are not native to the natural gene encoding DHAD. Alternatively, the coding region may be from another host cell.

Codons may be optimized for expression based on codon usage in the selected host, as is known to one skilled in the art. Vectors useful for the transformation of a variety of host cells are common and described in the literature. Typically the vector contains a selectable marker and sequences allowing autonomous replication or chromosomal integration in the desired host. In addition, suitable vectors may comprise a promoter region which harbors transcriptional initiation controls and a transcriptional termination control region, between which a coding region DNA fragment may be inserted, to provide expression of the inserted coding region. Both control regions may be derived from genes homologous to the transformed host cell, although it is to be understood that such control regions may also be derived from genes that are not native to the specific species chosen as a production host.

Initiation control regions or promoters, which are useful to drive expression of a DHAD coding region in LAB are familiar to those skilled in the art. Some examples include the amy, apr, and npr promoters; nisA promoter (useful for expression Gram-positive bacteria (Eichenbaum et al. *Appl. Environ. Microbiol.* 64(8):2763-2769 (1998)); and the synthetic P11 promoter (useful for expression in *Lactobacillus plantarum*, Rud et al., *Microbiology* 152:1011-1019 (2006)). In addition, the ldhL1 and fabZ1 promoters of *L plantarum* are useful for expression of chimeric genes in LAB. The fabZ1 promoter directs transcription of an operon with the first gene, fabZ1, encoding (3R)-hydroxymyristoyl-[acyl carrier protein] dehydratase.

Termination control regions may also be derived from various genes, typically from genes native to the preferred hosts. Optionally, a termination site may be unnecessary, however, it is most preferred if included.

Vectors useful in LAB include vectors having two origins of replication and one or two selectable markers which allow for replication and selection in both *Escherichia coli* and LAB. Examples are pFP996(SEQ ID NO:565) and pDM1 (SEQ ID NO:563), which are useful in *L. plantarum* and other LAB. Many plasmids and vectors used in the transformation of *Bacillus subtilis* and *Streptococcus* may be used generally for LAB. Non-limiting examples of suitable vectors include pAMβ1 and derivatives thereof (Renault et al., *Gene* 183: 175-182 (1996); and O'Sullivan et al., *Gene* 137:227-231 (1993)); pMBB1 and pHW800, a derivative of pMBB1 (Wyckoff et al. *Appl. Environ. Microbiol.* 62:1481-1486 (1996)); pMG1, a conjugative plasmid (Tanimoto et al., *J. Bacteriol.* 184:5800-5804 (2002)); pNZ9520 (Kleerebezem et al., *Appl. Environ. Microbiol.* 63:4581-4584 (1997)); pAM401 (Fujimoto et al., *Appl. Environ. Microbiol.* 67:1262-1267 (2001)); and pAT392 (Arthur et al., *Antimicrob. Agents Chemother.* 38:1899-1903 (1994)). Several plasmids from *Lactobacillus plantarum* have also been reported (e.g., van Kranenburg R, Golic N, Bongers R, Leer R J, de Vos W M, Siezen R J, Kleerebezem M. *Appl. Environ. Microbiol.* March 2005; 71(3): 1223-1230).

Vectors may be introduced into a host cell using methods known in the art, such as electroporation (Cruz-Rodz et al. *Molecular Genetics and Genomics* 224:1252-154 (1990), Bringel, et al. *Appl. Microbiol. Biotechnol.* 33: 664-670 (1990), Alegre et al., *FEMS Microbiology letters* 241:73-77 (2004)), and conjugation (Shrago et al., *Appl. Environ. Microbiol.* 52:574-576 (1986)). A chimeric DHAD gene can also be integrated into the chromosome of LAB using integration vectors (Hols et al., *Appl. Environ. Microbiol.* 60:1401-1403 (1990), Jang et al., *Micro. Lett.* 24:191-195 (2003)).

Reduced Lactate Dehydrogenase Activity

DHAD activity of at least about 0.1, 0.2, 0.4 or 0.6 µmol min$^{-1}$ mg$^{-1}$ may be achieved in a LAB cell by modifying the cell such that it is substantially free of lactate dehydrogenase enzyme activity. Lactate dehydrogenases are known as EC 1.1.1.27 (L-lactate dehydrogenase) or EC 1.1.1.28 (D-lactate dehydrogenase). At least one genetic modification is made in a LAB cell to render it substantially free of lactate dehydrogenase activity. DHAD is expressed as described above in the so modified LAB cell.

Endogenous lactate dehydrogenase activity in lactic acid bacteria (LAB) converts pyruvate to lactate. LAB may have one or more genes, typically one, two or three genes, encoding lactate dehydrogenase. For example, *Lactobacillus plantarum* has three genes encoding lactate dehydrogenase which are named ldhL2 (protein SEQ ID NO: 500, coding region SEQ ID NO: 499), ldhD (protein SEQ ID NO: 496, coding region SEQ ID NO: 495), and ldhL1 (protein SEQ ID NO: 498, coding region SEQ ID NO: 497). *Lactococcus lactis* has one gene encoding lactate dehydrogenase which is named ldhL (protein SEQ ID NO: 502, coding region SEQ ID NO: 501), and *Pediococcus pentosaceus* has two genes named ldhD (protein SEQ ID NO: 508, coding region SEQ ID NO: 507) and ldhL (protein SEQ ID NO: 510, coding region SEQ ID NO: 509).

In the present LAB strains, lactate dehydrogenase activity is reduced so that the cells are substantially free of lactate dehydrogenase activity. Genetic modification is made in at least one gene encoding lactate dehydrogenase to reduce activity. When more than one lactate dehydrogenase gene is active under the growth conditions to be used, each of these active genes may be modified to reduce expression. For example, in *L. plantarum* ldhL1 and ldhD genes are modified. It is not necessary to modify the third gene, ldhL2, for growth in typical conditions as this gene appears to be inactive in these conditions. Typically, expression of one or more genes encoding lactate dehydrogenase is disrupted to reduce expressed enzyme activity. Examples of LAB lactate dehydrogenase genes that may be targeted for disruption are represented by the coding regions of SEQ ID NOs: 495, 497, 499, 501, 503, 505, 507, 509, 511, 513, and 515 listed in Table 4. Other target genes, such as those encoding lactate dehydrogenase proteins having at least about 80-85%, 85%-90%, 90%-95%, or 98% sequence identity to the lactate dehydrogenases of SEQ ID NOs:496, 498, 500, 502, 504, 506, 508, 510, 512, 514, and 516 listed in Table 4 may be identified in the literature and using bioinformatics approaches, as is well known to the skilled person, since lactate dehydrogenases are well known. Typically BLAST (described above) searching of publicly available databases with known lactate dehydrogenase amino acid sequences, such as those provided herein, is used to identify lactate dehydrogenases, and their encoding sequences, that may be targets for disruption to reduce lactate dehydrogenase activity. Identities are based on the Clustal W method of alignment using the default parameters of GAP PENALTY=10, GAP LENGTH PENALTY=0.1, and Gonnet 250 series of protein weight matrix.

Additionally, the sequences described herein or those recited in the art may be used to identify other homologs in nature in other LAB strains as described above for DHAD homolog analysis.

In the present LAB strains, at least one modification is engineered that results in cells substantially free of lactate dehydrogenase activity. This may be accomplished by eliminating expression of at least one endogenous gene encoding lactate dehydrogenase. Any genetic modification method known by one skilled in the art for reducing the expression of a protein may be used to alter lactate dehydrogenase expression. Methods include, but are not limited to, deletion of the entire or a portion of the lactate dehydrogenase encoding gene, inserting a DNA fragment into the lactate dehydrogenase encoding gene (in either the promoter or coding region) so that the encoded protein cannot be expressed, introducing a mutation into the lactate dehydrogenase coding region which adds a stop codon or frame shift such that a functional protein is not expressed, and introducing one or more mutations into the lactate dehydrogenase coding region to alter amino acids so that a non-functional protein is expressed. In addition lactate dehydrogenase expression may be blocked by expression of an antisense RNA or an interfering RNA, and constructs may be introduced that result in cosuppression. All of these methods may be readily practiced by one skilled in the art making use of the known lactate dehydrogenase encoding sequences such as those of SEQ ID NOs: 495, 497, 499, 501, 503, 505, 507, 509, 511, 513, and 515.

For some methods genomic DNA sequences that surround a lactate dehydrogenase encoding sequence are useful, such as for homologous recombination-based methods. These sequences may be available from genome sequencing projects such as for *Lactobacillus plantarum*, which is available through the National Center for Biotechnology Information (NCBI) database, with Genbank™ identification gi|28376974|ref|NC_004567.1|[28376974]. Adjacent genomic DNA sequences may also be obtained by sequencing outward from a lactate dehydrogenase coding sequence using primers within the coding sequence, as well known to one skilled in the art.

A particularly suitable method for creating a genetically modified LAB strain with substantially no lactate dehydrogenase activity, as exemplified herein in Example 1, is using homologous recombination mediated by lactate dehydrogenase coding region flanking DNA sequences to delete the entire gene. The flanking sequences are cloned adjacent to each other so that a double crossover event using these flanking sequences deletes the lactate dehydrogenase coding region.

Isobutanol and other Products

Isobutanol and any other product made from a biosynthetic pathway including DHAD activity may be produced with greater effectiveness in a LAB cell disclosed herein having at least about 0.1, 0.2, or 0.4 $\mu$mol min$^{-1}$ mg$^{-1}$ DHAD activity. Such products include, but are not limited to valine, isoleucine, leucine, pantothenic acid (vitamin B5), 2-methyl-1-butanol, 3-methyl-1-butanol, and isobutanol.

For example, biosynthesis of valine includes steps of acetolactate conversion to 2,3-dihydroxy-isovalerate by acetohydroxyacid reductoisomerase (ilvC), conversion of 2,3-dihydroxy-isovalerate to $\alpha$-ketoisovalerate (also called 2-ketoisovalerate) by dihydroxy-acid dehydratase (ilvD), and conversion of a-ketoisovalerate to valine by branched-chain amino acid aminotransferase (ilvE). Biosynthesis of leucine includes the same steps to $\alpha$-ketoisovalerate, followed by conversion of $\alpha$-ketoisovalerate to leucine by enzymes encoded by leuA (2-isopropylmalaate synthase), leuCD (isopropylmalate isomerase), leuB (3-isopropylmalate dehydrogenase), and tyrB/ilvE (aromatic amino acid transaminase). Biosynthesis of pantothenate includes the same steps to $\alpha$-ketoisovalerate, followed by conversion of $\alpha$-ketoisovalerate to pantothenate by enzymes encoded by panB (3-methyl-2-oxobutanoate hydroxymethyltransferase), panE (2-dehydropantoate reductae), and panC (pantoate-beta-alanine ligase). Engineering expression of enzymes for enhanced production of pantothenic acid in microorganisms is described in U.S. Pat. No. 6,177,264.

Increased conversion of 2,3-dihydroxy-isovalerate to $\alpha$-ketoisovalerate will increase flow in these pathways, particularly if one or more additional enzymes of a pathway is overexpressed. Thus it is desired for production of, for example, valine, leucine, or pantothenate to use an engineered LAB cell disclosed herein.

The $\alpha$-ketoisovalerate product of DHAD is an intermediate in isobutanol biosynthetic pathways disclosed in commonly owned and co-pending US Patent Pub No. 20070092957 A1, which is herein incorporated by reference. A diagram of the disclosed isobutanol biosynthetic pathways is provided in FIG. 1. Production of isobutanol in a strain disclosed herein benefits from increased DHAD activity. As described in US Patent Pub No. US20070092957 A1, steps in an example isobutanol biosynthetic pathway include conversion of:

pyruvate to acetolactate (FIG. 1 pathway step a), as catalyzed for example by acetolactate synthase, acetolactate to 2,3-dihydroxyisovalerate (FIG. 1 pathway step b) as catalyzed for example by acetohydroxy acid isomeroreductase;

2,3-dihydroxyisovalerate to a-ketoisovalerate (FIG. 1 pathway step c) as catalyzed for example by acetohydroxy acid dehydratase, also called dihydroxy-acid dehydratase (DHAD);

$\alpha$-ketoisovalerate to isobutyraldehyde (FIG. 1 pathway step d) as catalyzed for example by branched-chain $\alpha$-keto acid decarboxylase; and isobutyraldehyde to isobutanol (FIG. 1 pathway step e) as catalyzed for example by branched-chain alcohol dehydrogenase.

The substrate to product conversions, and enzymes involved in these reactions, for steps f, g, h, I, j, and k of alternative pathways are described in US Patent Pub No. US20070092957 A1.

Genes that may be used for expression of the pathway step enzymes named above other than the DHADs disclosed herein, as well as those for two additional isobutanol pathways, are described in US Patent Pub No. 20070092957 A1, and additional genes that may be used can be identified by one skilled in the art through bioinformatics or experimentally as described above. The preferred use in all three pathways of ketol-acid reductoisomerase (KARI) enzymes with particularly high activities is disclosed in co-pending US Patent Pub No. US20080261230 A1. Examples of high activity KARIs disclosed therein are those from Vibrio cholerae (DNA: SEQ ID NO:517; protein SEQ ID NO:518), *Pseudomonas aeruginosa* PAO1, (DNA: SEQ ID NO:523; protein SEQ ID NO:524), and *Pseudomonas fluorescens* PF5 (DNA: SEQ ID NO:519; protein SEQ ID NO:520).

Additionally described in US Patent Pub No. 20070092957 A1 are construction of chimeric genes and genetic engineering of bacteria for isobutanol production using the disclosed biosynthetic pathways. Expression of these enzymes in LAB is as described above for expression of DHADs.

Growth for Production

Recombinant LAB cells disclosed herein may be used for fermentation production of isobutanol and other products as follows. The recombinant cells are grown in fermentation media which contains suitable carbon substrates. Suitable substrates may include but are not limited to monosaccharides such as glucose and fructose, or mixtures of monosaccharides that include C5 sugars such as xylose and arabinose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt.

Although it is contemplated that all of the above mentioned carbon substrates and mixtures thereof are suitable in the present invention, preferred carbon substrates are glucose, fructose, and sucrose. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in co-owned and co-pending US Patent Pub No. US20070031918A1, which is herein incorporated by reference. Biomass refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

In addition to an appropriate carbon source, fermentation media must contain suitable minerals, salts, cofactors, buffers and other components, known to those skilled in the art, suitable for the growth of the cultures and promotion of the enzymatic pathway necessary for isobutanol production.

Typically cells are grown at a temperature in the range of about 25° C. to about 40° C. in an appropriate medium. Suitable growth media are common commercially prepared media such as Bacto Lactobacilli MRS broth or Agar (Difco), Luria Bertani (LB) broth, Sabouraud Dextrose (SD) broth or Yeast Medium (YM) broth. Other defined or synthetic growth media may also be used, and the appropriate medium for growth of the particular bacterial strain will be known by one skilled in the art of microbiology or fermentation science. The use of agents known to modulate catabolite repression directly or indirectly, e.g., cyclic adenosine 2':3'-monophosphate, may also be incorporated into the fermentation medium.

Suitable pH ranges for the fermentation are between pH 5.0 to pH 9.0, where pH 6.0 to pH 8.0 is preferred as the initial condition.

Fermentations may be performed under aerobic or anaerobic conditions, where anaerobic or microaerobic conditions are preferred.

Isobutanol, or other product, may be produced using a batch method of fermentation. A classical batch fermentation is a closed system where the composition of the medium is set at the beginning of the fermentation and not subject to artificial alterations during the fermentation. A variation on the standard batch system is the fed-batch system. Fed-batch fermentation processes are also suitable in the present invention and comprise a typical batch system with the exception that the substrate is added in increments as the fermentation progresses. Fed-batch systems are useful when catabolite repression is apt to inhibit the metabolism of the cells and where it is desirable to have limited amounts of substrate in the media. Batch and fed-batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.*, 36:227, (1992), herein incorporated by reference.

Isobutanol, or other product, may also be produced using continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth. Continuous fermentation allows for the modulation of one factor or any number of factors that affect cell growth or end product concentration. Methods of modulating nutrients and growth factors for continuous fermentation processes as well as techniques for maximizing the rate of product formation are well known in the art of industrial microbiology and a variety of methods are detailed by Brock, supra.

It is contemplated that the production of isobutanol, or other product, may be practiced using batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

Bioproduced isobutanol may be isolated from the fermentation medium using methods known in the art for ABE fermentations (see for example, Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the isobutanol may be isolated from the fermentation medium using methods such as distillation, azeotropic distillation, liquid-liquid extraction, adsorption, gas stripping, membrane evaporation, or pervaporation.

EXAMPLES

The present invention is further defined in the following Examples.

It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

The meaning of abbreviations used is as follows: "min" means minute(s), "h" means hour(s), "sec' means second(s), "µl" means microliter(s), "ml" means milliliter(s), "L" means liter(s), "nm" means nanometer(s), "mm" means millimeter(s), "cm" means centimeter(s), "µm" means micrometer(s), "mM" means millimolar, "M" means molar, "mmol" means millimole(s), "µmole" means micromole(s), "g" means gram(s), "pg" means microgram(s), "mg" means milligram(s), "rpm" means revolutions per minute, "w/v" means weight/volume, "OD" means optical density, and "OD600" means optical density measured at a wavelength of 600 nm.

General Methods:

Standard recombinant DNA and molecular cloning techniques used in the Examples are well known in the art and are described by Sambrook, J., Fritsch, E. F. and Maniatis, T., *Molecular Cloning: A Laboratory Manual*, Cold Spring Harbor Laboratory Press, Cold Spring Harbor, N.Y., 1989, by T. J. Silhavy, M. L. Bennan, and L. W. Enquist, *Experiments with Gene Fusions*, Cold Spring Harbor Laboratory, Cold Spring Harbor, N.Y., 1984, and by Ausubel, F. M. et al., *Current Protocols in Molecular Biology*, Greene Publishing Assoc. and Wiley-Interscience, N.Y., 1987. Additional methods used in the Examples are described in manuals including Advanced Bacterial Genetics (Davis, Roth and Botstein, Cold Spring Harbor Laboratory, 1980), Experiments with Gene Fusions (Silhavy, Berman and Enquist, Cold Spring Harbor Laboratory, 1984), Experiments in Molecular Genetics (Miller, Cold Spring Harbor Laboratory, 1972) Experimental Techniques in Bacterial Genetics (Maloy, in Jones and Bartlett, 1990), and A Short Course in Bacterial Genetics (Miller, Cold Spring Harbor Laboratory 1992).

Example 1

Construction of dihydroxy-acid dehydratase (DHAD) Expression Cassettes

The purpose of this example is to describe how to clone and express a gene encoding dihydroxy-acid dehydratase (ilvD) from different bacterial sources in *Lactobacillus plantarum* PN0512 (ATCC PTA-7727) and *Lactobacillus plantarum* PN0512 carrying a double lactate dehydrogenase deletion, ΔldhDΔldhL1.

A *Lactobacillus plantarum* PN0512 strain that is deleted for the two genes that encode the major lactate dehydrogenases was prepared as follows. The major end product of fermentation in *Lactobacillus plantarum* is lactic acid. Pyruvate is converted to lactate by the action of two lactate dehydrogenases encoded by the IdhD and IdhL1 genes. A double deletion of IdhD and IdhL1 was made in *Lactobacillus plantarum* PN0512 (ATCC strain #PTA-7727).

Gene knockouts were constructed using a process based on a two-step homologous recombination procedure to yield unmarked gene deletions (Ferain et al., 1994, *J. Bact.* 176: 596). The procedure utilized a shuttle vector, pFP996 (SEQ ID NO:565). pFP996 is a shuttle vector for gram-positive bacteria. It can replicate in both *E. coli* and gram-postive bacteria. It contains the origins of replication from pBR322 (nucleotides #2628 to 5323) and pE194 (nucleotides #43 to 2627). pE194 is a small plasmid isolated originally from a gram positive bacterium, *Staphylococcus aureus* (Horinouchi and Weisblum J. Bacteriol. (1982) 150(2):804-814). In pFP996, the multiple cloning sites (nucleotides #1 to 50) contain restriction sites for EcoRI, BglII, XhoI, SmaI, ClaI, KpnI, and HindIII. There are two antibiotic resistance markers; one is for resistance to ampicillin and the other for resistance to erythromycin. For selection purposes, ampicillin was used for transformation in *E. coli* and erythromycin was used for selection in *L. plantarum*.

Two segments of DNA, each containing 900 to 1200 bp of sequence either upstream or downstream of the intended deletion, were cloned into the plasmid to provide the regions of homology for the two genetic cross-overs. Cells were grown for an extended number of generations (30-50) to allow for the cross-over events to occur. The initial cross-over (single cross-over) integrated the plasmid into the chromosome by homologous recombination through one of the two homology regions on the plasmid. The second cross-over (double cross-over) event yielded either the wild-type sequence or the intended gene deletion. A cross-over between the sequences that led to the initial integration event would yield the wild-type sequence, while a cross-over between the other regions of homology would yield the desired deletion. The second cross-over event was screened for by antibiotic sensitivity. Single and double cross-over events were analyzed by PCR and DNA sequencing.

All restriction enzymes, DNA modifying enzymes and Phusion High-Fidelity PCR Master Mix were purchased from NEB Inc. (Ipswich, Mass.). PCR SuperMix and Platinum PCR SuperMix High Fidelity were purchased from Invitrogen Corp (Carlsbad, Calif.). DNA fragments were gel purified using Zymoclean™ Gel DNA Recovery Kit (Zymo Research Corp, Orange, Calif.) or Qiaquick PCR Purification Kit (Qiagen Inc., Valencia, Calif.). Plasmid DNA was prepared with QIAprep Spin Miniprep Kit (Qiagen Inc., Valencia, Calif.). Oligoucleotides were synthesized by Sigma-Genosys (Woodlands, Tex.) or Invitrogen Corp (Carlsbad, Calif.). *L. plantarum* PN0512 genomic DNA was prepared with MasterPure DNA Purification Kit (Epicentre, Madison, Wis.).

*Lactobacillus plantarum* PN0512 was transformed by the following procedure: 5 ml of Lactobacilli MRS medium (Accumedia, Neogen Corporation, Lansing, Mich.) containing 1% glycine (Sigma-Aldrich, St. Louis, Mo.) was inoculated with PN0512 cells and grown overnight at 30° C. 100 ml MRS medium with 1% glycine was inoculated with overnight culture to an OD600 of 0.1 and grown to an OD600 of 0.7 at 30° C. Cells were harvested at 3700×g for 8 min at 4° C., washed with 100 ml cold 1 mM $MgCl_2$ (Sigma-Aldrich, St. Louis, Mo.), centrifuged at 3700×g for 8 min at 4° C., washed with 100 ml cold 30% PEG-1000 (Sigma-Aldrich, St. Louis, Mo.), recentrifuged at 3700×g for 20 min at 4° C., then resuspended in 1 ml cold 30% PEG-1000. 60 μl cells were mixed with ~100 ng plasmid DNA in a cold 1 mm gap electroporation cuvette and electroporated in a BioRad Gene Pulser (Hercules, Calif.) at 1.7 kV, 25 μF, and 400Ω. Cells were resuspended in 1 ml MRS medium containing 500 mM sucrose (Sigma-Aldrich, St. Louis, Mo.) and 100 mM $MgCl_2$, incubated at 30° C. for 2 hrs, plated on MRS medium plates containing 1 or 2 μg/ml of erythromycin (Sigma-Aldrich, St. Louis, Mo.), then placed in an anaerobic box containing a Pack-Anaero sachet (Mitsubishi Gas Chemical Co., Tokyo, Japan) and incubated at 30° C.

ΔldhD

The knockout cassette to delete the IdhD gene was created by amplifying from PN0512 genomic DNA an upstream flanking region with primers Top D F1 (SEQ ID NO:572) containing an EcoRI site and Top D R1 (SEQ ID NO:573). The downstream homology region including part of the coding sequence of IdhD was amplified with primers Bot D F2 (SEQ ID NO:574) and Bot D R2 (SEQ ID NO:575) containing an XhoI site. The two homology regions were joined by PCR SOE as follows. The 0.9 kbp upstream and downstream PCR products were gel-purified. The PCR products were mixed in equal amounts in a PCR reaction and re-amplified with primers Top D F1 and Bot D R2. The final 1.8 kbp PCR product was gel-purifed and TOPO cloned into pCR4BluntII-TOPO (Invitrogen) to create vector pCRBluntII::IdhD. To create the integration vector carrying the internal deletion of the IdhD gene, pFP996 was digested with EcoRI and XhoI and the 5311-bp fragment gel-purified. Vector pCRBluntII::IdhD was digested with EcoRI and XhoI and the 1.8 kbp fragment gel-purified. The IdhD knockout cassette and vector were ligated using T4 DNA ligase, resulting in vector pFP996::IdhD ko.

Electrocompetent *Lactobacillus plantarum* PN0512 cells were prepared, transformed with pFP996::IdhD ko, and plated on MRS containing 1 μg/ml of erythromycin. To obtain the single-crossover event (sco), transformants were passaged for approximately 50 generations in MRS medium at 37° C. After growth, aliquots were plated for single colonies on MRS containing 1 μg/ml of erythromycin. The erythromycin-resistant colonies were screened by PCR amplification with primers IdhD Seq F1 (SEQ ID NO:576) and D check R (SEQ ID NO:577) to distinguish between wild-type and clones carrying the sco event. To obtain clones with a double crossover, the sco strains were passaged for approximately 30 generations in MRS medium with 20 mM D, L-lactate (Sigma, St. Louis, Mo.) at 37° C. and then plated for single colonies on MRS with lactate. Colonies were picked and patched onto MRS with lactate and MRS with lactate containing 1 µg/ml of erythromycin to find colonies sensitive to erythromycin. Sensitive colonies were screened by PCR amplification using primer D check R (SEQ ID NO:577) and D check F3 (SEQ ID NO:578). Wild-type colonies gave a 3.2 kbp product and deletion clones, called PN0512ΔIdhD, gave a 2.3 kbp PCR product.

ΔIdhDΔIdhL1

A deletion of the IdhL1 gene was made in the PN0512ΔIdhD strain background in order to make a double ΔIdhL1ΔIdhD deletion strain. The knockout cassette to delete the IdhL1 gene was amplified from PN0512 genomic DNA. The IdhL1 left homologous arm was amplified using primers oBP31 (SEQ ID NO:579) containing a BglII restriction site and oBP32 (SEQ ID NO:580) containing an XhoI restriction site. The IdhL1 right homologous arm was amplified using primers oBP33 (SEQ ID NO:581) containing an XhoI restriction site and oBP34 (SEQ ID NO:582) containing an XmaI restriction site. The IdhL1 left homologous arm was cloned into the BglII/XhoI sites and the IdhL1 right homologous arm was cloned into the XhoI/XmaI sites of pFP996pyrFΔerm, a derivative of pFP996. pFP996pyrFΔerm contains the pyrF sequence (SEQ ID NO:571) encoding orotidine-5'-phosphate decarboxylase from *Lactobacillus plantarum* PN0512 in place of the erythromycin coding region in pFP996. The plasmid-borne pyrF gene, in conjunction with the chemical 5-fluoroorotic acid in a ΔpyrF strain, can be used as an effective counter-selection method in order to isolate the second homologous crossover. The XmaI fragment containing the IdhL1 homologous arms was isolated following XmaI digestion and cloned into the XmaI restriction site of pFP996, yielding a 900 by left homologous region and a 1200 by right homologous region resulting in vector pFP996-IdhL1-arms.

PN0512ΔIdhD was transformed with pFP996-IdhL1-arms and grown at 30° C. in Lactobacilli MRS medium with lactate (20 mM) and erythromycin (1 µg/ml) for approximately 10 generations. Transformants were then grown under non-selective conditions at 37° C. for about 50 generations by serial inoculations in MRS+lactate before cultures were plated on MRS containing lactate and erythromycin (1 µg/ml). Isolates were screened by colony PCR for a single crossover using chromosomal specific primer oBP49 (SEQ ID NO:583) and plasmid specific primer oBP42 (SEQ ID NO:584). Single crossover integrants were grown at 37° C. for approximately 40 generations by serial inoculations under non-selective conditions in MRS with lactate before cultures were plated on MRS medium with lactate. Isolates were patched to MRS with lactate plates, grown at 37° C., and then patched onto MRS plates with lactate and erythromycin (1µg/ml). Erythromycin sensitive isolates were screened by colony PCR for the presence of a wild-type or deletion second crossover using chromosomal specific primers oBP49 (SEQ ID NO:583) and oBP56 (SEQ ID NO:585). A wild-type sequence yielded a 3505 by product and a deletion sequence yielded a 2545 by product. The deletions were confirmed by sequencing the PCR product and absence of plasmid was tested by colony PCR with primers oBP42 (SEQ ID NO:584) and oBP57 (SEQ ID NO:586).

The *Lactobacillus plantarum* PN0512 double IdhDIdhL1 deletion strain was designated PNP0001. The ΔIdhD deletion included 83 by upstream of where the IdhD start codon was through amino acid 279 of 332. The ΔIdhL1 deletion included the fMet through the final amino acid.

ilvD Expression

The *E. coli-L. plantarum* shuttle vector pDM1 (SEQ ID NO:563) was used for cloning and expression of ilvD coding regions from *Lactococcus lactis* subsp *lactis* NCDO2118 (NCIMB #702118) [Godon et al., J. Bacteriol. (1992) 174: 6580-6589] and *Streptococcus mutans* ATCC #700610 in *L. plantarum* PN0512. Plasmid pDM1 contains a minimal pLF1 replicon (~0.7 Kbp) and pemK-pemI toxin-antitoxin(TA) from *Lactobacillus plantarum* ATCC14917 plasmid pLF1, a P15A replicon from pACYC184, chloramphenicol marker for selection in both *E. coli* and *L. plantarum*, and P30 synthetic promoter [Rud et al, *Microbiology* (2006) 152:1011-1019]. Plasmid pLF1 (C.-F. Lin et al., GenBank accession no. AF508808) is closely related to plasmid p256 [Sørvig et al., *Microbiology* (2005) 151:421-431], whose copy number was estimated to be ~5-10 copies per chromosome for *L. plantarum* NC7. A P30 synthetic promoter was derived from *L. plantarum* rRNA promoters that are known to be among the strongest promoters in lactic acid bacteria (LAB) [Rud et al. *Microbiology* (2005) 152:1011-1019].

The *Lactococcus lactis* ilvD coding region (SEQ ID NO:564) was PCR-amplified from *Lactococcus lactis* subsp *lactis* NCDO2118 genomic DNA with primers 3T-ilvDLI (BamHI) (SEQ ID NO:557) and 5B-ilvDLI(NotI) (SEQ ID NO:558). *L. lactis* subsp *lactis* NCDO2118 genomic DNA was prepared with a Puregene Gentra Kit (QIAGEN; Valencia,Calif.). The 1.7 Kbp *L. lactis* ilvD PCR product (ilvDLI) was digested with NotI and treated with the Klenow fragment of DNA polymerase to make blunt ends. The resulting *L. lactis* ilvD coding region fragment was digested with BamHI and gel-purified using a QIAGEN gel extraction kit (QIAGEN). Plasmid pDM1 was digested with ApaLI, treated with the Klenow fragment of DNA polymerase to make blunt ends, and then digested with BamHI. The gel purified *L. lactis* ilvD coding region fragment was ligated into the BamHI and ApaLI(blunt) sites of the plasmid pDM1.The ligation mixture was transformed into *E. coli* Top10 cells (Invitrogen; Carlsbad, Calif.). Transformants were plated for selection on LB chloramphenicol plates. Positive clones were screened by SalI digestion, giving one fragment with an expected size of 5.3 Kbp. The positive clones were further confirmed by DNA sequencing. The correct clone was named pDM1-ilvD(*L. lactis*), which has the *L. lactis* ilvD coding region expressed from P30.

The *S. mutans* ATCC 700610 ilvD coding region was PCR-amplified with a specific forward primer with an NheI restriction site (SEQ ID NO:559) and a specific reverse primer with a NotI restriction site (SEQ ID NO:560). The genomic DNA of *Streptococcus mutans* ATCC 700610 was used as a template. Genomic DNA was prepared using a MasterPure DNA Purification Kit (Epicentre, Madison, Wis.). The plasmid vector pET28a (Novagen, Germany) was amplified with primers pET28a-F(NotI) (SEQ ID NO:561) and pET28a-R(NheI) (SEQ ID NO:562). Both coding region and plasmid fragments were digested with NheI and NotI, and ligated. The ligation mixture was transformed into *E. coli* (Top 10) competent cells (Invitrogen). Transformants were grown on LB agar plates supplemented with 50 µg/ml of kanamycin. Positive clones were confirmed by DNA sequencing. The *S. mutans* ilvD coding region from the plasmid pET28a was then sub-cloned into the *E. coli-L. plantarum* shuttle vector pDM1. The plasmid pET28a containing the *S. mutans* ilvD was digested with XbaI and NotI, treated with the Klenow fragment of DNA polymerase to make blunt ends, and a 1,759 by fragment containing the *S. mutans* ilvD coding region was gel-purified. Plasmid pDM1 was digested with BamHI, treated with the Klenow fragment of DNA polymerase to make blunt ends, and then digested with PvuII. The gel purified fragment containing *S. mutans* ilvD coding region was ligated into the BamHI(blunt) and PvuII sites of the plasmid pDM1. The ligation mixture was transformed into *E. coli* Top10 cells (Invitrogen, Carlsbad, Calif.). Transformants were plated for selection on LB chloramphenicol plates. Positive clones were screened by ClaI digestion, giving one fragment with an expected size of 5.5 Kbp. The correct clone was named pDM1-ilvD(*S. mutans*), which has the *S. mutans* ilvD coding region expressed from P30.

Example 2

Measurement of Expressed DHAD Activity

*L. plantarum* PN0512 and *L. plantarum* PN0512 ΔldhD-ΔldhL1 were transformed with plasmid pDM1-ilvD(*L. lactis*) or pDM1-ilvD(*S. mutans*) by electroporation. Electrocompetent cells were prepared by the following procedure. 5 ml of Lactobacilli MRS medium was inoculated with PN0512 colonies from a freshly grown MRS plate and grown overnight at 30° C. 100 ml MRS medium was inoculated with the overnight culture to an OD600=0.1 and grown to an OD600=0.7 at 30° C. Cells were harvested at 3700×g for 8 min at 4° C., washed with 100 ml cold 1 mM $MgCl_2$, centrifuged at 3700×g for 8 min at 4° C., washed with 100 ml cold 30% PEG-1000 (81188, Sigma-Aldrich, St. Louis, Mo.), recentrifuged at 3700×g for 20 min at 4° C., then resuspended in 1 ml cold 30% PEG-1000. 60 μl of electro-competent cells were mixed with ~100 ng plasmid DNA in a cold 1 mm gap electroporation cuvette and electroporated in a BioRad Gene Pulser (Hercules, Calif.) at 1.7 kV, 25 μF, and 400Ω. Cells were resuspended in 1 ml MRS medium containing 500 mM sucrose and 100 mM $MgCl_2$, incubated at 30° C. for 2 hrs, and then plated on MRS medium plates containing 10 μg/ml of chloramphenicol.

*L. plantarum* PN0512 and *L. plantarum* PN0512 ΔldhD-ΔldhL1, which carried pDM1-ilvD(*L. lactis*) or pDM1-ilvD (*S. mutans*), as well as control transformants with the pDM1 vector alone, were grown overnight in Lactobacilli MRS medium at 30° C. 120 ml of MRS medium supplemented with 100 mM MOPS (pH7.5), 40 μM ferric citrate, 0.5 mM L-cysteine, and 10 μg/ml chloramphenicol was inoculated with overnight culture to an OD600=0.1 in a 125 ml screw cap flask, for each overnight sample. The cultures were anaerobically incubated at 37° C. until reaching an OD600 of 1-2. Cultures were centrifuged at 3700×g for 10 min at 4° C. Pellets were washed with 50 mM potassium phosphate buffer pH 6.2 (6.2 g/L $KH_2PO_4$ and 1.2 g/L $K_2HPO_4$) and re-centrifuged. Pellets were frozen and stored at −80° C. until assayed for DHAD activity.

Enzymatic activity of the crude extract was assayed at 37° C. as follows. Cells to be assayed for DHAD were suspended in 2-5 volumes of 50 mM Tris, 10 mM $MgSO_4$, pH 8.0 (TM8) buffer, then broken by sonication at 0° C. The crude extract from the broken cells was centrifuged to pellet the cell debris. The supernatants were removed and stored on ice until assayed (initial assay was within 2 hrs of breaking the cells). It was found that the DHADs assayed herein were stable in crude extracts kept on ice for a few hours. The activity was also preserved when small samples were frozen in liquid $N_2$ and stored at −80° C.

The supernatants were assayed using the reagent 2,4-dinitrophenyl hydrazine as described in Flint and Emptage (J. Biol. Chem. (1988) 263: 3558-64). When the activity was so high that it became necessary to dilute the crude extract to obtain an accurate assay, the dilution was done in 5 mg/ml BSA in TM8. Protein assays were performed using the Pierce Better Bradford reagent (cat #23238) using BSA as a standard. Dilutions for protein assays were made in TM8 buffer when necessary.

The DHAD activity results are given in Table 8. Specific activity of *L. lactis* DHAD and *S. mutans* DHAD in *L. plantarum* PN0512 showed 0.014 and 0.067 μmol $min^{-1}$ $mg^{-1}$, respectively, while the vector control sample exhibited no detectable activity. Specific activity of *L. lactis* DHAD and *S. mutans* DHAD in *L. plantarum* PN0512 ΔldhDΔldhL1 showed 0.052 and 0.106 μmol $min^{-1}$ $mg^{-1}$, respectively, which increased 3.7 fold and 1.6 fold in the specific activity as compared to the activity in PN0512.

TABLE 8

DHAD activity in *L. plantarum* PN0512 and *L. plantarum* PN0512 ΔldhDΔldhL1.

| | | Specific Activity (μmol $min^{-1}$ $mg^{-1}$) | |
| --- | --- | --- | --- |
| Source of DHAD | Plasmid | PN0512 | PN0512 ΔldhDΔldhL1 |
| Vector control | pDM1 | 0.000 | 0.000 |
| *Lactococcus lactis* subsp *lactis* NCDO2118 | pDM1-ilvD (*L. lactis*) | 0.014 | 0.052 |
| *Streptococcus mutans* ATCC 700610 | pDM1-ilvD (*S. mutans*) | 0.067 | 0.106 |

Example 3

Construction of Plasmid for Expression of *Lactococcus lactis* ilvD

The purpose of this example is to describe the construction of another plasmid used for the expression of *Lactococcus lactis* ilvD (SEQ ID NO:564). The shuttle vector pDM1 (SEQ ID NO:563), described in Example 1, was used for construction of the plasmid for expression of the ilvD gene from *Lactococcus lactis* subsp *lactis* NCDO2118 (NCIMB 702118) [Godon et al., J. Bacteriol. (1992) 174:6580-6589]. The plasmid was constructed using standard molecular biology methods known in the art. All restriction and modifying enzymes and Phusion High-Fidelity PCR Master Mix were purchased from New England Biolabs (Ipswich, Mass.). DNA fragments were purified with Qiaquick PCR Purification Kit (Qiagen Inc., Valencia, Calif.). Plasmid DNA was prepared with QIAprep Spin Miniprep Kit (Qiagen Inc., Valencia, Calif.). Oligoucleotides were synthesized by Sigma-Genosys (Woodlands, Tex.). All vector constructs were confirmed by DNA sequencing.

Vector pDM1 was modified by deleting nucleotides 3281-3646 spanning the lacZ region and replacing with a multi cloning site. Primers oBP120 (SEQ ID NO:567), containing an XhoI site, and oBP182 (SEQ ID NO:568), containing DrdI, PstI, HindIII, and BamHI sites, were used to amplify the P30 promoter from pDM1 with Phusion High-Fidelity PCR Master Mix. The resulting PCR product and vector pDM1 were digested with XhoI and DrdI. This digestion cuts out the lacZ region and P30. The PCR product and the large fragment of the pDM1 digestion were ligated to yield vector pDM20, which has P30 restored along with addition of the multi cloning site.

The ilvD coding region (SEQ ID NO:564) from *Lactococcus lactis* subsp *lactis* and a ribosome binding sequence (SEQ ID NO:566) were cloned into pDM20 to create vector pDM20-ilvD(LI). Primers oBP190 (SEQ ID NO:569), containing a BamHI site and ribosome binding sequence, and oBP192 (SEQ ID NO:570), containing a PstI site, were used to amplify the ilvD coding region from vector pDM1-ilvD(*L. lactis*), which was described in Example 1, with Phusion High-Fidelity PCR Master Mix. The resulting PCR product and pDM20 were ligated after digestion with BamHI and PstI to yield vector pDM20-ilvD(LI), with the ilvD coding region downstream of the P30 promoter.

Example 4

Increased DHAD Activity with Expression of *Lactococcus lactis* ilvD in a ΔldhDΔldhL1 *Lactobacillus plantarum* Strain Background The purpose of this example is to demonstrate the effect on DHAD activity, from expression of *L. lactis* ilvD, of the *L. plantarum* ΔldhDΔldhL1 background as compared to the wild-type background.

*Lactobacillus plantarum* PN0512 and *Lactobacillus plantarum* PN0512ΔldhDΔldhL1 were transformed with vector pDM20-ilvD(LI). Cells were transformed as in Example 1, except transformants were selected for on MRS medium plates containing 10 μg/ml of chloramphenicol and strain PN0512ΔldhDΔldhL1 was grown in the absence of glycine. The transformed strains were called PN0512/pDM20-ilvD (LI) and PN0512ΔldhDΔldhL1/pDM20-ilvD(LI). These two strains were grown in 50 ml of Lactobacilli MRS medium supplemented with 100 mM MOPS (Sigma-Aldrich, St. Louis, Mo.), 40 μM ferric citrate (Sigma-Aldrich, St. Louis, Mo.), 0.5 mM L-cysteine (Sigma-Aldrich, St. Louis, Mo.), and 10 μg/ml chloramphenicol adjusted to pH 7 with KOH, which had been deoxygenated in an anaerobic chamber (Coy Laboratories Inc., Grass Lake, Mich.), in 50 ml conical tubes at 37° C. in the anaerobic chamber until reaching an OD600 of approximately 1.5-2.8. Cultures were centrifuged at 3700×g for 10 min at 4° C. Pellets were washed with 50 mM potassium phosphate buffer pH 6.2 (6.2 g/L $KH_2PO_4$ (Sigma-Aldrich, St. Louis, Mo.) and 1.2 g/L $K_2HPO_4$ (Sigma-Aldrich, St. Louis, Mo.)) and re-centrifuged. Pellets were frozen and stored at −80° C. until assayed for DHAD activity. Samples were assayed for DHAD activity using a dinitrophenylhydrazine based method as described in Example 2, except cells were broken using a bead beater with Lysing Matrix B (MP Biomedicals, Solon, Ohio).

The two strains were grown and assayed using the same conditions three separate times. The DHAD activity results for each experiment, as well as the average, are given in Table 9. Expression of the *L. lactis* DHAD in the *L. plantarum* ΔldhDΔldhL1 background led on average to approximately a 10-fold increase in DHAD activity compared to expression in the wild-type background.

TABLE 9

Expression of *L. lactis* DHAD in wild-type *Lactobacillus plantarum* PN0512 and *Lactobacillus plantarum* PN0512ΔldhDΔldhL1. DHAD activity is in μmoles KIVA/min/mg total protein.

| Expt. | Strain | DHAD Activity |
|---|---|---|
| 1 | PN0512/pDM20-ilvD(Ll) | 0.021 |
| 1 | PN0512ΔldhDΔldhL1/pDM20-ilvD(LI) | 0.575 |
| 2 | PN0512/pDM20-ilvD(Ll) | 0.042 |
| 2 | PN0512ΔldhDΔldhL1/pDM20-ilvD(LI) | 0.643 |
| 3 | PN0512/pDM20-ilvD(Ll) | 0.052 |
| 3 | PN0512ΔldhDΔldhL1/pDM20-ilvD(LI) | 0.223 |
| Avg | PN0512/pDM20-ilvD(Ll) | 0.038 |
| Avg | PN0512ΔldhDΔldhL1/pDM20-ilvD(LI) | 0.480 |

TABLE 7

| HMM | A m->m | C m->i | D m->d | E i->m | F i->i | G d->m | H d->d | I b->m | K m->e | L | M | N | P | Q | R | S | T | V | W | Y | Position in alignment |
|---|---|---|---|---|---|---|---|---|---|---|---|---|---|---|---|---|---|---|---|---|---|
| 1(M) | -538 | * | -1684 | 1223 | -1477 | -1132 | 89 | -1122 | 420 | -1248 | 1757 | 1553 | -1296 | 464 | -24 | -190 | -188 | -838 | -1578 | -985 | 6 |
| — | -233 | -1296 | 99 | 43 | -381 | 399 | 106 | -626 | 210 | -466 | -720 | 275 | 394 | 45 | 96 | 359 | 117 | -369 | -294 | -249 | |
| — | -149 | -500 | 233 | -894 | -1115 | -701 | -1378 | -538 | * | | | | | | | | | | | | |
| — | -29 | -6203 | -7245 | | | | | | | | | | | | | | | | | | |
| 2(E) | -220 | -1288 | 232 | 1356 | -1807 | 1016 | -70 | -1474 | 190 | -1584 | -775 | 132 | -1298 | 300 | -282 | -183 | 1140 | -1092 | -1872 | -1262 | 7 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 3(K) | -448 | -1932 | 1558 | 658 | -2220 | -1048 | 40 | -1983 | 1569 | -1938 | -1091 | 1558 | -1319 | 450 | -193 | -278 | -419 | -1552 | -2121 | -1397 | 8 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 4(V) | -404 | -498 | -1497 | -939 | -588 | -1810 | -640 | 1591 | 914 | -127 | 335 | -962 | -1866 | -562 | -767 | -868 | -357 | 1720 | -1169 | -763 | 9 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 5(E) | -265 | -1340 | -52 | 1376 | -1572 | -1189 | 113 | -1125 | 1345 | -1287 | -496 | 99 | -1321 | 505 | 198 | -218 | -205 | 597 | -1598 | -1032 | 10 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 6(S) | 256 | -397 | -1014 | -830 | -1841 | -646 | -862 | -1443 | -767 | -1740 | -963 | -568 | -1249 | -651 | -1007 | 2267 | 1586 | -862 | -2080 | -1672 | 11 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 7(M) | -990 | -889 | -2630 | 157 | -513 | -2514 | -1346 | 1309 | -1767 | 820 | 3683 | -1898 | -2491 | -1496 | -1799 | -1589 | -925 | 150 | -1336 | -1041 | 12 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -29 | -6203 | -7245 | -894 | -1115 | -701 | -1378 | * | | | | | | | | | | | | | |
| 8(E) | -16 | -1875 | -8150 | 1536 | -2188 | -1373 | -59 | -1931 | 957 | -1890 | -977 | 904 | 292 | 393 | -162 | 483 | -372 | -1495 | -2070 | -1391 | 13 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 9(N) | -514 | -1116 | 1207 | -315 | 447 | -1650 | -304 | -778 | -224 | 825 | -277 | 1457 | -1738 | -123 | -618 | -627 | -454 | -603 | -1186 | 763 | 14 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 10(N) | -815 | -1190 | -1360 | -922 | -904 | -1967 | -797 | -442 | -670 | 381 | 1700 | 3009 | -2099 | -654 | -934 | -1051 | -791 | -445 | -1490 | -979 | 15 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 11(K) | -1530 | -2498 | -1722 | -855 | -3141 | -2246 | -428 | -2627 | 2828 | -2404 | -1656 | -927 | 662 | -2 | 2047 | -1421 | -1337 | -2324 | -2357 | -2081 | 16 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 12(Y) | -872 | -1887 | -861 | -290 | -1369 | -1801 | 1662 | -1797 | 325 | -1793 | -1031 | 893 | -1876 | 56 | 2219 | -812 | -780 | -1514 | -1565 | 2287 | 17 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 13(S) | -830 | -1586 | -1471 | -1099 | -2717 | -1642 | -1010 | -2479 | -266 | -2518 | -1746 | -1065 | -2069 | -676 | 1822 | 2748 | -1000 | -1950 | -2597 | -2189 | 18 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 14(Q) | -851 | -2131 | -775 | -153 | -2554 | -1735 | -211 | -2205 | 1908 | -2094 | -1244 | -386 | -1802 | 2254 | 974 | 1001 | -747 | -1819 | -2181 | -1667 | 19 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 15(T) | -405 | -1258 | -618 | -100 | -1490 | -1466 | 1158 | -1121 | 1 | -1299 | -514 | 578 | -1607 | 65 | -433 | 960 | 1849 | 343 | -1677 | -1143 | 20 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |

TABLE 7-continued

| | | | | | | | | | | | | | | | | |
|---|---|---|---|---|---|---|---|---|---|---|---|---|---|---|---|---|
| 16(I) | −1772 −149 −16 | −1325 −500 −7108 | −4307 233 −8150 | −3877 43 −894 | −1405 −381 −1115 | −3993 399 −701 | −3383 106 −1378 | 2935 −626 * | −3705 210 * | 820 −466 | −217 −720 | −3632 275 | −3761 394 | −3400 45 | −3682 96 | −3260 359 | −1742 117 | 2033 −369 | −2838 −294 | −2525 −249 | 21 |
| 17(T) | −1018 −149 −16 | −1329 −500 −7108 | −2004 233 −8150 | −1771 43 −894 | −409 −381 −1115 | −1993 399 −701 | −1000 106 −1378 | −1256 −626 * | −1512 210 * | −1464 −466 | −966 −720 | −1543 275 | −2367 394 | −1428 45 | −1638 96 | −1257 359 | 3050 117 | −1090 −369 | −1012 −294 | 2448 −249 | 22 |
| 18(Q) | −1509 −149 −16 | −3056 −500 −7108 | 1970 233 −8150 | 44 43 −894 | −3310 −381 −1115 | −1666 399 −701 | −896 106 −1378 | −3242 −626 * | −877 210 * | −3158 −466 | −2439 −720 | −322 275 | −2123 394 | 3562 45 | −1493 96 | −1259 359 | −1550 117 | −2779 −369 | −3260 −294 | −2446 −249 | 23 |
| 19(D) | −1006 −149 −16 | −2199 −500 −7108 | 2178 233 −8150 | −88 43 −894 | −3159 −381 −1115 | 1997 399 −701 | −936 106 −1378 | −2974 −626 * | −948 210 * | −2977 −466 | −2174 −720 | −382 275 | −1960 394 | −589 45 | −1571 96 | 1295 359 | −1157 117 | −2369 −369 | −3178 −294 | −2430 −249 | 24 |
| 20(M) | 445 −149 −16 | −796 −500 −7108 | −1082 233 −8150 | −521 43 −894 | −841 −381 −1115 | −1643 399 −701 | −412 106 −1378 | −403 −626 * | −370 210 * | −692 −466 | 2213 −720 | −646 275 | 536 394 | 1166 45 | −698 96 | −630 359 | 660 117 | 831 −369 | −1204 −294 | −767 −249 | 25 |
| 21(Q) | 741 −149 −16 | −990 −500 −7108 | −1025 233 −8150 | −507 43 −894 | −1249 −381 −1115 | −1551 399 −701 | −519 106 −1378 | −720 −626 * | −357 210 * | −1062 −466 | −345 −720 | −635 275 | −1739 394 | 1770 45 | −713 96 | −589 359 | 1576 117 | 1129 −369 | −1559 −294 | −1097 −249 | 26 |
| 22(R) | −1753 −149 −16 | −2648 −500 −7108 | −2072 233 −8150 | −1047 43 −894 | −3365 −381 −1115 | −2405 399 −701 | −452 106 −1378 | −2782 −626 * | 1989 210 * | −2495 −466 | −1773 −720 | −1062 275 | −2379 394 | 2402 45 | 2643 96 | −1629 359 | −1506 117 | −2504 −369 | −2397 −294 | −2190 −249 | 27 |
| 23(S) | −330 −149 −16 | −1010 −500 −7108 | −1820 233 −8150 | −1628 43 −894 | −2778 −381 −1115 | −1229 399 −701 | −1652 106 −1378 | −2481 −626 * | −1592 210 * | −2691 −466 | −1841 −720 | −1273 275 | 2130 394 | −1426 45 | −1834 96 | 2449 359 | 1034 117 | −1716 −369 | −2961 −294 | −2594 −249 | 28 |
| 24(P) | 1882 −149 −16 | −1119 −500 −7108 | −2231 233 −8150 | −2302 43 −894 | −3062 −381 −1115 | −1360 399 −701 | −2209 106 −1378 | −2710 −626 * | −2339 210 * | −3013 −466 | −2243 −720 | −1676 275 | 3304 394 | −2117 45 | −2409 96 | −742 359 | −918 117 | −1916 −369 | −3263 −294 | −3022 −249 | 29 |
| 25(N) | 969 −149 −16 | −1230 −500 −7108 | −1066 233 −8150 | −915 43 −894 | −2593 −381 −1115 | −1313 399 −701 | −1196 106 −1378 | −2242 −626 * | −1033 210 * | −2447 −466 | −1626 −720 | 3197 275 | −1850 394 | −898 45 | −1392 96 | −582 359 | 1155 117 | −1644 −369 | −2736 −294 | −2256 −249 | 30 |
| 26(R) | −1847 −149 −16 | −2640 −500 −7108 | −2014 233 −8150 | −1161 43 −894 | −3282 −381 −1115 | −2428 399 −701 | −579 106 −1378 | −2818 −626 * | 687 210 * | −2553 −466 | −1869 −720 | −1165 275 | −2462 394 | 2447 45 | 3181 96 | −1746 359 | −1630 117 | −2555 −369 | −2447 −294 | −2228 −249 | 31 |
| 27(A) | 3048 −149 −16 | −932 −500 −7108 | −2480 233 −8150 | −2533 43 −894 | −3075 −381 −1115 | −1200 399 −701 | −2274 106 −1378 | −2765 −626 * | −2501 210 * | −3071 −466 | −2221 −720 | −1658 275 | −1948 394 | −2205 45 | −2512 96 | 1225 359 | −739 117 | −1842 −369 | −3322 −294 | −3078 −249 | 32 |
| 28(M) | −2406 −149 −16 | −2296 −500 −7108 | −3638 233 −8150 | −3594 43 −894 | −1525 −381 −1115 | −3105 399 −701 | −2824 106 −1378 | −1047 −626 * | −3121 210 * | −596 −466 | 5043 −720 | −3293 275 | −3425 394 | −3046 45 | −2996 96 | −2911 359 | −2552 117 | −1398 −369 | −2513 −294 | −2207 −249 | 33 |
| 29(Y) | −1674 −149 −16 | −1506 −500 −7108 | −2863 233 −8150 | −2464 43 −894 | 596 −381 −1115 | −2872 399 −701 | 2251 106 −1378 | −972 −626 * | −2024 210 * | 2197 −466 | −552 −720 | −1986 275 | −2876 394 | −1739 45 | −1988 96 | −1987 359 | −1601 117 | −1002 −369 | −95 −294 | 2332 −249 | 34 |
| 30(Y) | −2013 −149 −16 | −2305 −500 −7108 | −2428 233 −8150 | −1781 43 −894 | −328 −381 −1115 | −2709 399 −701 | −654 106 −1378 | −2240 −626 * | −258 210 * | −2064 −466 | −1626 −720 | −1631 275 | −2788 394 | −899 45 | 2789 96 | −2017 359 | −1896 117 | −2130 −369 | −857 −294 | 3434 −249 | 35 |
| 31(A) | 2822 −149 −16 | −1031 −500 −7108 | −2418 233 −8150 | −2539 43 −894 | −3226 −381 −1115 | 1898 399 −701 | −2364 106 −1378 | −2941 −626 * | −2626 210 * | −3229 −466 | −2379 −720 | −1722 275 | −2026 394 | −2302 45 | −2634 96 | −654 359 | −848 117 | −1983 −369 | −3415 −294 | −3226 −249 | 36 |
| 32(I) | −1247 −149 −16 | −941 −500 −7108 | −3569 233 −8150 | −3039 43 −894 | −1082 −381 −1115 | −3101 399 −701 | −2185 106 −1378 | 2227 −626 * | −2763 210 * | 766 −466 | −76 −720 | −2700 275 | −3050 394 | −2469 45 | −2697 96 | −2253 359 | 1322 117 | 1974 −369 | −1988 −294 | −1633 −249 | 37 |

TABLE 7-continued

| | | | | | | | | | | | | | | | | | | |
|---|---|---|---|---|---|---|---|---|---|---|---|---|---|---|---|---|---|---|
| 33(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 38 |
| 34(F) | −1511 −149 −16 | −1236 −500 −7108 | −3511 233 −8150 | −3017 43 −894 | 2747 −381 −1115 | −2982 399 −701 | −1069 106 −1378 | −260 −626 * | −2651 210 * | 992 −466 | 2737 −720 | −2407 275 | −2904 394 | −2088 45 | −2418 96 | −2099 359 | −1434 117 | −489 −369 | −537 −294 | 2056 −249 | 39 |
| 35(Q) | −576 −149 −16 | −1869 −500 −7108 | −401 233 −8150 | 92 43 −894 | −2232 −381 −1115 | 831 399 −701 | −173 106 −1378 | −1930 −626 * | 1505 210 * | −1913 −466 | −1042 −720 | −186 275 | −1620 394 | 1653 45 | −51 96 | −482 359 | 1346 117 | −1534 −369 | −2098 −294 | −1490 −249 | 40 |
| 36(D) | −1352 −149 −16 | −3066 −500 −7108 | 3028 233 −8150 | 1349 43 −894 | −3303 −381 −1115 | −1566 399 −701 | −724 106 −1378 | −3141 −626 * | 1155 210 * | −3043 −466 | −2267 −720 | −165 275 | −1991 394 | −354 45 | −1350 96 | −1086 359 | −1368 117 | −2659 −369 | −3221 −294 | −2356 −249 | 41 |
| 37(E) | −1507 −149 −16 | −3288 −500 −7108 | 2042 233 −8150 | 2762 43 −894 | −3520 −381 −1115 | 515 399 −701 | −853 106 −1378 | −3401 −626 * | −981 210 * | −3296 −466 | −2566 −720 | −182 275 | −2064 394 | −503 45 | −1753 96 | −1209 359 | −1553 117 | −2895 −369 | −3486 −294 | −2547 −249 | 42 |
| 38(D) | −1445 −149 −16 | −2778 −500 −7108 | 3529 233 −8150 | −53 43 −894 | −3524 −381 −1115 | −1590 399 −701 | −1129 106 −1378 | −3476 −626 * | −1367 210 * | −3459 −466 | −2774 −720 | −396 275 | −2156 394 | −825 45 | −2122 96 | 554 359 | −1609 117 | −2880 −369 | −3582 −294 | −2717 −249 | 43 |
| 39(F) | −2658 −149 −16 | −2176 −500 −7108 | −4213 233 −8150 | −4000 43 −894 | 3815 −381 −1115 | −3933 399 −701 | −1352 106 −1378 | −531 −626 * | −3638 210 * | 1121 −466 | −19 −720 | −3184 275 | −3709 394 | −2820 45 | −3296 96 | −3219 359 | −2579 117 | −1037 −369 | −601 −294 | 403 −249 | 44 |
| 40(D) | −684 −149 −16 | −2193 −500 −7108 | 1738 233 −8150 | 1460 43 −894 | −2494 −381 −1115 | −1437 399 −701 | −249 106 −1378 | −2257 −626 * | 1694 210 * | −2199 −466 | −1308 −720 | −62 275 | −1637 394 | 185 45 | −450 96 | −531 359 | 633 117 | −1808 −369 | −2374 −294 | −1657 −249 | 45 |
| 41(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 46 |
| 42(P) | 1882 −149 −16 | −1119 −500 −7108 | −2231 233 −8150 | −2302 43 −894 | −3062 −381 −1115 | −1360 399 −701 | −2209 106 −1378 | −2710 −626 * | −2339 210 * | −3013 −466 | −2243 −720 | −1676 275 | 3304 394 | −2117 45 | −2409 96 | −742 359 | −918 117 | −1916 −369 | −3263 −294 | −3022 −249 | 47 |
| 43(I) | −1006 −149 −16 | −992 −500 −7108 | −2347 233 −8150 | −1784 43 −894 | −650 −381 −1115 | −2452 399 −701 | −1256 106 −1378 | 2372 −626 * | −1386 210 * | 77 −466 | 2213 −720 | −1720 275 | −2455 394 | 2030 45 | −1490 96 | −1528 359 | −946 117 | 106 −369 | −1441 −294 | −1111 −249 | 48 |
| 44(V) | −1771 −149 −16 | −1603 −500 −7108 | −3750 233 −8150 | −3689 43 −894 | −2037 −381 −1115 | −3050 399 −701 | −3231 106 −1378 | −2257 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 49 |
| 45(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 50 |
| 46(I) | −1759 −149 −16 | −1303 −500 −7108 | −4330 233 −8150 | −3968 43 −894 | −1751 −381 −1115 | −4051 399 −701 | −3743 106 −1378 | 3027 −626 * | −3837 210 * | −597 −466 | −528 −720 | −3729 275 | −3875 394 | −3688 45 | −3910 96 | −3369 359 | −1751 117 | 2438 −369 | −3259 −294 | −2819 −249 | 51 |
| 47(V) | 1736 −149 −16 | −1012 −500 −7108 | −3546 233 −8150 | −3078 43 −894 | −1377 −381 −1115 | −3073 399 −701 | −2434 106 −1378 | 2052 −626 * | −2843 210 * | −608 −466 | −331 −720 | −2754 275 | −3122 394 | −2619 45 | −2855 96 | −2270 359 | −1277 117 | 2193 −369 | −2333 −294 | −1941 −249 | 52 |
| 48(N) | −686 −149 −16 | −1511 −500 −7108 | −702 233 −8150 | −806 43 −894 | −2927 −381 −1115 | −1386 399 −701 | −1339 106 −1378 | −2841 −626 * | −1264 210 * | −2950 −466 | −2137 −720 | −1217 275 | −1979 394 | −1062 45 | −1648 96 | −2444 359 | −971 117 | −2105 −369 | −3054 −294 | −2475 −249 | 53 |
| 49(M) | −411 −149 −16 | −857 −500 −7108 | −1800 233 −8150 | −1434 43 −894 | −1528 −381 −1115 | 1914 399 −701 | −1202 106 −1378 | −1029 −626 * | −1247 210 * | −1347 −466 | 2989 −720 | −1217 275 | −1912 394 | −1119 45 | −1444 96 | −676 359 | 1550 117 | −767 −369 | −1922 −294 | −1539 −249 | 54 |

TABLE 7-continued

| | | | | | | | | | | | | | | | | | | |
|---|---|---|---|---|---|---|---|---|---|---|---|---|---|---|---|---|---|---|
| 50(W) | −782 −149 −16 | −1258 −500 −7108 | 793 233 −8150 | −683 −894 43 | 1193 −381 −1115 | 346 399 −701 | 2051 106 −1378 | −932 −626 * | −556 210 * | −1092 −466 | −441 −720 | −798 275 | −1993 394 | −426 45 | −909 96 | −904 359 | −720 117 | −779 −369 | 3163 −294 | 1546 −249 | 55 |
| 51(W) | 1009 −149 −16 | −798 −500 −7108 | −1470 233 −8150 | −935 43 −894 | −463 −381 −1115 | −1773 399 −701 | −545 106 −1378 | −460 −626 * | −751 210 * | −736 −466 | −66 −720 | −943 275 | −1904 394 | −606 45 | −1002 96 | 1604 359 | −507 117 | −322 −369 | 2535 −294 | 1521 −249 | 56 |
| 52(D) | −1137 −149 −16 | −2711 −500 −7108 | 2125 233 −8150 | 1647 43 −894 | −2995 −381 −1115 | −1523 399 −701 | −617 106 −1378 | −2786 −626 * | −528 210 * | −2743 −466 | −1933 −720 | −150 275 | −1897 394 | −234 45 | −1165 96 | −924 359 | 2117 117 | −2331 −369 | −2948 −294 | −2141 −249 | 57 |
| 53(I) | −599 −149 −16 | −1102 −500 −7108 | −1031 233 −8150 | −829 43 −894 | −1522 −381 −1115 | 1429 399 −701 | −927 106 −1378 | 2119 −626 * | −880 210 * | −1369 −466 | −699 −720 | 1692 275 | −1938 394 | −759 45 | −1188 96 | −799 359 | −698 117 | −689 −369 | −1887 −294 | −1419 −249 | 58 |
| 54(T) | −666 −149 −16 | −1412 −500 −7108 | −954 233 −8150 | −984 43 −894 | −2702 −381 −1115 | −1428 399 −701 | −1357 106 −1378 | −2418 −626 * | −1208 210 * | −2650 −466 | −1886 −720 | 2293 275 | −2000 394 | −1101 45 | −1519 96 | −787 359 | 2967 117 | −1835 −369 | −2866 −294 | −2360 −249 | 59 |
| 55(P) | −632 −149 −16 | −1230 −500 −7108 | −2074 233 −8150 | −2144 43 −894 | −2996 −381 −1115 | −1453 399 −701 | −2116 106 −1378 | −2631 −626 * | −2128 210 * | −2928 −466 | −2213 −720 | −1658 275 | 3610 394 | −2006 45 | −2221 96 | −852 359 | 1302 117 | −1931 −369 | −3185 −294 | −2917 −249 | 60 |
| 56(C) | −2476 −149 −16 | 5735 −500 −7108 | −4102 233 −8150 | −4358 −894 43 | −3712 −381 −1115 | −2763 399 −701 | −3545 106 −1378 | −3518 −626 * | −4167 210 * | −3859 −466 | −3569 −720 | −3631 275 | −3363 394 | −4030 45 | −3832 96 | −2793 359 | −2860 117 | −3158 −369 | −3464 −294 | −3718 −249 | 61 |
| 57(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 62 |
| 58(M) | 672 −149 −16 | −918 −500 −7108 | −3119 233 −8150 | −2578 43 −894 | −742 −381 −1115 | −2668 399 −701 | −1734 106 −1378 | 1807 −626 * | −2263 210 * | 16 −466 | 3713 −720 | −2271 275 | −2704 394 | −1960 45 | −2216 96 | −1806 359 | −1058 117 | 493 −369 | −1612 −294 | −1306 −249 | 63 |
| 59(H) | −1525 −149 −16 | −2164 −500 −7108 | −1235 233 −8150 | −1346 43 −894 | −2509 −381 −1115 | 2296 399 −701 | 4235 106 −1378 | −3172 −626 * | −1516 210 * | −3178 −466 | −2523 −720 | −1448 275 | −2541 394 | −1520 45 | −1760 96 | −1591 359 | −1741 117 | −2656 −369 | −2681 −294 | −2065 −249 | 64 |
| 60(L) | −2478 −149 −16 | −2009 −500 −7108 | 4717 233 −8150 | −4196 43 −894 | −568 −381 −1115 | −4424 399 −701 | −3262 106 −1378 | 1334 −626 * | −3887 210 * | 2824 −466 | 604 −720 | −4085 275 | −3872 394 | −3088 45 | −3590 96 | −3717 359 | −2380 117 | −199 −369 | −2217 −294 | −2207 −249 | 65 |
| 61(H) | −682 −149 −16 | −2191 −500 −7108 | 1015 233 −8150 | 275 43 −894 | −2485 −381 −1115 | 396 399 −701 | 2379 106 −1378 | −2251 −626 * | 62 210 * | −2197 −466 | −1307 −720 | 1826 275 | −1636 394 | 1527 45 | −480 96 | −529 359 | −641 117 | −1803 −369 | −2375 −294 | −1654 −249 | 66 |
| 62(D) | −575 −149 −16 | −1920 −500 −7108 | 1979 233 −8150 | 184 43 −894 | −2299 −381 −1115 | 94 399 −701 | −242 106 −1378 | −2029 −626 * | 114 210 * | −2023 −466 | −1144 −720 | −120 275 | −1608 394 | 186 45 | 1063 96 | −469 359 | 1413 117 | −1605 −369 | −2229 −294 | −1561 −249 | 67 |
| 63(L) | −2618 −149 −16 | −2139 −500 −7108 | −4597 233 −8150 | −4163 43 −894 | 2144 −381 −1115 | −4285 399 −701 | −2334 106 −1378 | −83 −626 * | −3854 210 * | 2690 −466 | 538 −720 | −3771 275 | −3806 394 | −2950 45 | −3488 96 | −3563 359 | −2505 117 | −751 −369 | −1442 −294 | −808 −249 | 68 |
| 64(A) | 2657 −149 −16 | −1033 −500 −7108 | −2408 233 −8150 | −2532 43 −894 | −3233 −381 −1115 | 2193 399 −701 | −2364 106 −1378 | −2950 −626 * | −2626 210 * | −3237 −466 | −2386 −720 | −1719 275 | −2027 394 | −2301 45 | −2635 96 | −655 359 | −850 117 | −1988 −369 | −3420 −294 | −3231 −249 | 69 |
| 65(K) | −443 −149 −16 | −1857 −500 −7108 | 958 233 −8150 | 270 43 −894 | −2158 −381 −1115 | −1393 399 −701 | −66 106 −1378 | −1890 −626 * | 1839 210 * | −442 −466 | −957 −720 | −36 275 | −1499 394 | 1204 45 | −132 96 | 616 359 | −382 117 | −1469 −369 | −2048 −294 | −1383 −249 | 70 |
| 66(C) | 605 −149 −16 | 1553 −500 −7108 | 739 233 −8150 | −17 43 −894 | −1374 −381 −1115 | −1488 399 −701 | −182 106 −1378 | 260 −626 * | 969 210 * | −203 −466 | −397 −720 | −263 275 | −1573 394 | 159 45 | 691 96 | −426 359 | −331 117 | −761 −369 | −1567 −294 | −1032 −249 | 71 |

TABLE 7-continued

| | | | | | | | | | | | | | | | | | | | |
|---|---|---|---|---|---|---|---|---|---|---|---|---|---|---|---|---|---|---|---|
| 67(A) | 2327 −149 −16 | −956 −500 −7108 | −3193 233 −8150 | −2728 −894 | −1289 −381 −1115 | −2677 399 −701 | −2114 106 −1378 | 1664 −626 * | −2485 210 * | −601 −466 | −288 −720 | −2403 275 | −2839 394 | −2263 45 | −2523 96 | −1871 359 | −1126 117 | 1617 −369 | −2143 −294 | −1765 −249 | 72 |
| 68(K) | −532 −149 −16 | −1656 −500 −7108 | −490 233 −8150 | 1321 43 −894 | −1891 −381 −1115 | −1527 399 −701 | −172 106 −1378 | −124 −626 * | 2206 210 * | −1591 −466 | −782 −720 | −223 275 | −1619 394 | 237 45 | −106 96 | −482 359 | −464 117 | −98 −369 | −1904 −294 | −1326 −249 | 73 |
| 69(H) | 384 −149 −16 | −1854 −500 −7108 | 936 233 −8150 | 889 43 −894 | −2165 −381 −1115 | −1363 399 −701 | 1498 106 −1378 | −1909 −626 * | 1111 210 * | −1866 −466 | −948 −720 | 1091 275 | −1464 394 | 421 45 | −131 96 | −284 359 | −342 117 | −69 −369 | −2043 −294 | −1364 −249 | 74 |
| 70(G) | 1823 −149 −16 | −932 −500 −7108 | −2330 233 −8150 | −2313 43 −894 | −3120 −381 −1115 | 2511 399 −701 | −2158 106 −1378 | −2865 −626 * | −2331 210 * | −3098 −466 | −2209 −720 | −1563 275 | −1912 394 | −2032 45 | −2419 96 | 1138 359 | −706 117 | −1883 −369 | −3328 −294 | −3077 −249 | 75 |
| 71(V) | −1760 −149 −16 | −1333 −500 −7108 | −4244 233 −8150 | −3789 43 −894 | −1262 −381 −1115 | −3902 399 −701 | −3190 106 −1378 | 1495 −626 * | −3588 210 * | 1270 −466 | −96 −720 | −3536 275 | −3677 394 | −3238 45 | −3534 96 | −3148 359 | −1725 117 | 2865 −369 | −2654 −294 | −2373 −249 | 76 |
| 72(W) | −1054 −149 −16 | −2172 −500 −7108 | −1112 233 −8150 | −403 43 −894 | −2566 −381 −1115 | −1917 399 −701 | −286 106 −1378 | −2196 −626 * | 2516 210 * | −2095 −466 | −1292 −720 | 1183 275 | −1958 394 | 140 45 | 1333 96 | −959 359 | −922 117 | −1867 −369 | 2591 −294 | −1720 −249 | 77 |
| 73(D) | 611 −149 −16 | −1995 −500 −7108 | 1525 233 −8150 | 937 43 −894 | −2295 −381 −1115 | −1400 399 −701 | −148 106 −1378 | −2043 −626 * | 211 210 * | −2006 −466 | −1106 −720 | −37 275 | −1553 394 | 1420 45 | −312 96 | −408 359 | 1235 117 | −1609 −369 | −2193 −294 | −1499 −249 | 78 |
| 74(A) | 2716 −149 −16 | −902 −500 −7108 | −2380 233 −8150 | −2205 43 −894 | −2799 −381 −1115 | −1197 399 −701 | −1975 106 −1378 | −2459 −626 * | −2081 210 * | −2736 −466 | −1895 −720 | −1520 275 | −1895 394 | −1844 45 | −2201 96 | 1191 359 | 1299 117 | −1669 −369 | −3045 −294 | −2758 −249 | 79 |
| 75(G) | −1709 −149 −16 | −2833 −500 −7108 | 2424 233 −8150 | 409 43 −894 | −3781 −381 −1115 | 2819 399 −701 | −1457 106 −1378 | −3777 −626 * | −1728 210 * | −3733 −466 | −3076 −720 | −739 275 | −2389 394 | −1180 45 | −2441 96 | −1557 359 | −1893 117 | −3158 −369 | −3660 −294 | −3038 −249 | 80 |
| 76(A) | 2529 −149 −16 | −1119 −500 −7108 | −2614 233 −8150 | −2330 43 −894 | −1245 −381 −1115 | −1983 399 −701 | −1829 106 −1378 | −377 −626 * | −2042 210 * | 1435 −466 | −341 −720 | −1937 275 | −2411 394 | −1873 45 | −2088 96 | −1266 359 | −1059 117 | −397 −369 | −2063 −294 | −1713 −249 | 82 |
| 77(W) | −472 −149 −16 | −361 −500 −7108 | −2421 233 −8150 | −1812 43 −894 | −298 −381 −1115 | −1979 399 −701 | −826 106 −1378 | 1164 −626 * | −1486 210 * | −143 −466 | 2485 −720 | 873 275 | −2028 394 | −1185 45 | −1426 96 | −1048 359 | −412 117 | 1116 −369 | 2999 −294 | −454 −249 | 83 |
| 78(P) | −1198 −149 −16 | −1737 −500 −7108 | −2187 233 −8150 | −2394 43 −894 | −3665 −381 −1115 | 2006 399 −701 | −2550 106 −1378 | −3630 −626 * | −2743 210 * | −3756 −466 | −3008 −720 | −2052 275 | 3474 394 | −2495 45 | −2835 96 | −1401 359 | −1593 117 | −2736 −369 | −3511 −294 | −3519 −249 | 84 |
| 79(Q) | −999 −149 −16 | −1075 −500 −7108 | −2106 233 −8150 | −1568 43 −894 | −726 −381 −1115 | −2370 399 −701 | −1175 106 −1378 | 83 −626 * | −1185 210 * | 1373 −466 | 218 −720 | −1566 275 | −2400 394 | 2445 45 | −1340 96 | −1445 359 | −946 117 | 1441 −369 | −1501 −294 | −1146 −249 | 85 |
| 80(Q) | −885 −149 −16 | 779 −500 −7108 | −2609 233 −8150 | −2018 43 −894 | −481 −381 −1115 | −2414 399 −701 | −1253 106 −1378 | 1645 −626 * | −1736 210 * | 799 −466 | 1924 −720 | −1827 275 | −2405 394 | 2262 45 | −1752 96 | −1484 359 | −821 117 | 802 −369 | −1240 −294 | −935 −249 | 86 |
| 81(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 87 |
| 82(G) | −998 −149 −16 | −2100 −500 −7108 | −120 233 −8150 | −175 43 −894 | −2567 −381 −1115 | 2528 399 −701 | 2174 106 −1378 | −2558 −626 * | −587 210 * | −2583 −466 | −1806 −720 | 1422 275 | −1966 394 | −461 45 | −1038 96 | −925 359 | −1088 117 | −2095 −369 | −2657 −294 | −1948 −249 | 88 |
| 83(T) | −1213 −149 −16 | −1674 −500 −7108 | −2755 233 −8150 | −2906 43 −894 | −3163 −381 −1115 | −1922 399 −701 | −2659 106 1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 89 |

TABLE 7-continued

| | | | | | | | | | | | | | | | | | | |
|---|---|---|---|---|---|---|---|---|---|---|---|---|---|---|---|---|---|---|
| 84(I) | −1286 −149 −16 | −1279 −500 −7108 | −2907 233 −8150 | −2683 43 −894 | −1446 −381 −1115 | −2549 399 −701 | −2198 106 −1378 | 3290 −626 * | −2407 210 * | −726 −466 | −534 −720 | −2386 275 | 1172 394 | −2299 45 | −2437 96 | −1895 359 | −1392 117 | 283 −369 | −2302 −294 | −1913 −249 | 90 |
| 85(T) | −493 −149 −16 | −1105 −500 −7108 | −2189 233 −8150 | −2267 43 −894 | −3101 −381 −1115 | 1880 399 −701 | −2196 106 −1378 | −2791 −626 * | −2334 210 * | −3081 −466 | −2269 −720 | −1649 275 | −2058 394 | −2099 45 | −2410 96 | −719 359 | 3135 117 | −1948 −369 | −3282 −294 | −3046 −249 | 91 |
| 86(V) | −1750 −149 −16 | −1296 −500 −7108 | −4319 233 −8150 | −3957 43 −894 | −1765 −381 −1115 | −4038 399 −701 | −3733 106 −1378 | 2364 −626 * | −3826 210 * | −619 −466 | −543 −720 | −3716 275 | −3869 394 | −3685 45 | −3902 96 | −3354 359 | −1743 117 | 3012 −369 | −3265 −294 | −2817 −249 | 92 |
| 87(S) | 923 −149 −16 | −962 −500 −7108 | −2348 233 −8150 | −2422 43 −894 | −3132 −381 −1115 | −1207 399 −701 | −2248 106 −1378 | −2850 −626 * | −2440 210 * | −3140 −466 | −2285 −720 | −1624 275 | −1954 394 | −2158 45 | −2477 96 | 3171 359 | −758 117 | −1896 −369 | −3362 −294 | −3103 −249 | 93 |
| 88(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 94 |
| 89(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 95 |
| 90(I) | −1880 −149 −16 | −1493 −500 −7108 | −4193 233 −8150 | −3724 43 −894 | −953 −381 −1115 | −3837 399 −701 | −2980 106 −1378 | 3251 −626 * | −3420 210 * | 257 −466 | 2372 −720 | −3485 275 | −3608 394 | −3005 45 | −3310 96 | −3087 359 | −1840 117 | 617 −369 | −2373 −294 | −2155 −249 | 96 |
| 91(S) | 2150 −149 −16 | −939 −500 −7108 | −2407 233 −8150 | −2415 43 −894 | −3075 −381 −1115 | −1197 399 −701 | −2205 106 −1378 | −2781 −626 * | −2384 210 * | −3065 −466 | −2205 −720 | −1613 275 | −1936 394 | −2105 45 | −2436 96 | 2652 359 | −729 117 | −1850 −369 | −3306 −294 | −3049 −249 | 97 |
| 92(M) | −979 −149 −16 | −1455 −500 −7108 | −1242 233 −8150 | −1122 43 −894 | −1434 −381 −1115 | −1860 399 −701 | −1131 106 −1378 | −1171 −626 * | −974 210 * | −1285 −466 | 4091 −720 | 2176 275 | −2226 394 | −1017 45 | −1187 96 | −1166 359 | −1086 117 | −1063 −369 | −1929 −294 | −1345 −249 | 98 |
| 93(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 99 |
| 94(T) | −2406 −149 −16 | −2296 −500 −7108 | −3638 233 −8150 | −3594 43 −894 | −1525 −381 −1115 | −3105 399 −701 | −2824 106 −1378 | −1047 −626 * | −3121 210 * | −596 −466 | 5043 −720 | −3293 275 | −3425 394 | −3046 45 | −2996 96 | −2911 359 | −2552 117 | −1398 −369 | −2513 −294 | −2207 −249 | 100 |
| 95(E) | −959 −149 −16 | −1691 −500 −7108 | −1249 233 −8150 | −949 43 −894 | −2563 −381 −1115 | −1747 399 −701 | −929 106 −1378 | −2093 −626 * | 1282 210 * | −2263 −466 | −1554 −720 | −995 275 | −2115 394 | −600 45 | −354 96 | −1037 359 | 3152 117 | −1726 −369 | −2494 −294 | −2098 −249 | 101 |
| 96(G) | −572 −149 −16 | −1860 −500 −7108 | −208 233 −8150 | 2213 43 −894 | −2107 −381 −1115 | −1461 399 −701 | −191 106 −1378 | −1808 −626 * | 199 210 * | −116 −466 | −983 −720 | −127 275 | 318 394 | 1199 45 | −269 96 | −475 359 | −517 117 | −1448 −369 | −2078 −294 | −1441 −249 | 102 |
| 97(M) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 103 |
| 98(R) | −2097 −149 −16 | −2786 −500 −7108 | −2688 233 −8150 | −1415 43 −894 | −3622 −381 −1115 | −2625 399 −701 | −555 106 −1378 | −2964 −626 * | 2585 210 * | −2627 −466 | −1957 −720 | −1318 275 | −2577 394 | −137 45 | 3015 96 | −1979 359 | −1791 117 | −2732 −369 | −2469 −294 | −2363 −249 | 104 |
| 99(Y) | −3615 −149 −16 | −2706 −500 −7108 | −4169 233 −8150 | −4413 43 −894 | 2626 −381 −1115 | −4044 399 −701 | −396 106 −1378 | −2535 −626 * | −3993 210 * | −1939 −466 | −1985 −720 | −2747 275 | −3930 394 | −2852 45 | −3446 96 | −3296 359 | −3494 117 | −2686 −369 | 347 −294 | 4252 −249 | 105 |
| 100(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 106 |

TABLE 7-continued

| | | | | | | | | | | | | | | | | | |
|---|---|---|---|---|---|---|---|---|---|---|---|---|---|---|---|---|---|
| 101(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 107 |
| 102(V) | −1381 −149 −16 | −1065 −500 −7108 | −3714 233 −8150 | −3252 43 −894 | −1453 −381 −1115 | −3300 399 −701 | −2646 106 −1378 | 1872 −626 * | −3023 210 * | −615 −466 | −373 −720 | −2949 275 | −3287 394 | −2816 45 | −3039 96 | −2506 359 | 1346 117 | 2750 −369 | −2489 −294 | −2087 −249 | 108 |
| 103(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 109 |
| 104(R) | −2957 −149 −16 | −3022 −500 −7108 | −3318 233 −8150 | −2735 43 −894 | −3796 −381 −1115 | −2998 399 −701 | −1968 106 −1378 | −3912 −626 * | −846 210 * | −3631 −466 | −3157 −720 | −2611 275 | −3280 394 | −1724 45 | 4056 96 | −3026 359 | −2913 117 | −3650 −369 | −3096 −294 | −3185 −249 | 110 |
| 105(E) | −1719 −149 −16 | −3572 −500 −7108 | 2596 233 −8150 | 2779 43 −894 | −3767 −381 −1115 | −1632 399 −701 | −993 106 −1378 | −3700 −626 * | −1241 210 * | −3578 −466 | −2920 −720 | −234 275 | −2167 394 | −666 45 | −2090 96 | −1380 359 | −1789 117 | −3182 −369 | −3742 −294 | −2756 −249 | 111 |
| 106(V) | −1746 −149 −16 | −1296 −500 −7108 | −4308 233 −8150 | −3946 43 −894 | −1757 −381 −1115 | −4020 399 −701 | −3712 106 −1378 | 2190 −626 * | −3811 210 * | −614 −466 | −539 −720 | −3702 275 | −3858 394 | −3667 45 | −3884 96 | −3336 359 | −1740 117 | 3098 −369 | −3250 −294 | −2803 −249 | 112 |
| 107(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 113 |
| 108(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 114 |
| 109(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 115 |
| 110(S) | −352 −149 −16 | 2942 −500 −7108 | −2955 233 −8150 | −2957 43 −894 | −2876 −381 −1115 | −1254 399 −701 | −2382 106 −1378 | −2573 −626 * | −2692 210 * | −2927 −466 | −2128 −720 | −1827 275 | −2001 394 | −2405 45 | −2607 96 | 3103 359 | −778 117 | −1757 −369 | −3171 −294 | −2911 −249 | 116 |
| 111(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 117 |
| 112(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 118 |
| 113(T) | 1556 −149 −16 | −936 −500 −7108 | −2493 233 −8150 | −2457 43 −894 | −2805 −381 −1115 | −1256 399 −701 | −2159 106 −1378 | −2210 −626 * | −2319 210 * | −2681 −466 | −1932 −720 | −1656 275 | −1974 394 | −2089 45 | −2352 96 | −598 359 | 3235 117 | −1547 −369 | −3111 −294 | −2847 −249 | 119 |
| 114(C) | 1784 −149 −16 | 2119 −500 −7108 | −2013 233 −8150 | −1532 43 −894 | −1093 −381 −1115 | −1580 399 −701 | −1089 106 −1378 | −436 −626 * | −1322 210 * | −937 −466 | −273 −720 | 1093 275 | −1932 394 | −1127 45 | −1472 96 | −748 359 | −515 117 | 1585 −369 | −1536 −294 | −1163 −249 | 120 |
| 115(M) | 1831 −149 −16 | 2019 −500 −7108 | −2596 233 −8150 | −2038 43 −894 | −605 −381 −1115 | −1979 399 −701 | −1126 106 −1378 | 244 −626 * | −1727 210 * | −359 −466 | 2501 −720 | −1655 275 | −2145 394 | −1435 45 | −1683 96 | −1106 359 | −557 117 | 1087 −369 | −1153 −294 | −804 −249 | 121 |
| 116(Q) | −987 −149 −16 | −2211 −500 −7108 | −43 233 −8150 | −62 43 −894 | −2833 −381 −1115 | 2229 399 −701 | −691 106 −1378 | −2616 −626 * | −407 210 * | −2604 −466 | −1797 −720 | 1197 275 | −1917 394 | 2260 45 | −858 96 | −880 359 | −1045 117 | −2139 −369 | −2772 −294 | −2099 −249 | 122 |
| 117(G) | 2313 −149 −16 | −1042 −500 −7108 | −2391 233 −8150 | −2526 43 −894 | −3250 −381 −1115 | 2601 399 −701 | −2372 106 −1378 | −2972 −626 * | −2637 210 * | −3257 −466 | −2407 −720 | −1721 275 | −2032 394 | −2310 45 | −2646 96 | −662 359 | −859 117 | −2003 −369 | −3434 −294 | −3247 −249 | 123 |

TABLE 7-continued

| | | | | | | | | | | | | | | | | | | |
|---|---|---|---|---|---|---|---|---|---|---|---|---|---|---|---|---|---|---|
| 118(Q) | −914 | −2350 | −48 | 1661 | −2621 | −1571 | 2504 | −2400 | 68 | −2331 | −1486 | −201 | −1796 | 2646 | −351 | −754 | −865 | −1984 | −2463 | −1787 | 124 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 119(W) | −517 | −1294 | −733 | −183 | −1062 | −1605 | −234 | −1037 | 19 | −1207 | −456 | 1435 | −1690 | 33 | 756 | 411 | −454 | −819 | 3340 | 1286 | 125 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 120(M) | 410 | −469 | −2417 | −1828 | −341 | −2041 | −897 | 195 | −1513 | −156 | 3130 | −1534 | −2102 | −1230 | −1484 | −1117 | −507 | 954 | −894 | 2253 | 126 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 121(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 127 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 122(G) | 2142 | −930 | −2334 | −2298 | −3100 | 2237 | −2139 | −2842 | −2302 | −3074 | −2187 | −1557 | −1909 | −2010 | −2397 | 1136 | −701 | −1871 | −3308 | −3053 | 128 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 123(V) | −1514 | −1144 | −3950 | −3459 | 1821 | −3487 | −2577 | 2274 | −3208 | −209 | −87 | −3112 | −3362 | −2864 | −3118 | −2680 | −1476 | 2426 | −2194 | −1786 | 129 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 124(Y) | −1743 | −1294 | −4292 | −3873 | −1511 | −3988 | −3433 | 2287 | −3712 | 598 | −319 | −3626 | −3774 | −3456 | −3716 | −3260 | −1717 | 2790 | −2931 | −2577 | 130 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 125(A) | 2911 | −954 | −2808 | −2665 | −2115 | −1577 | −2196 | −575 | −2445 | −1646 | −1202 | −1906 | −2208 | −2218 | −2451 | −901 | −876 | 1294 | −2727 | −2394 | 131 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 126(I) | −1764 | −1323 | −4298 | −3936 | −1668 | −3994 | −3655 | 3337 | −3783 | −508 | −462 | −3689 | −3838 | −3608 | −3835 | −3311 | −1759 | 1847 | −3164 | −2747 | 132 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 127(G) | −1157 | −1705 | −2169 | −2375 | −3654 | 3021 | −2534 | −3611 | −2730 | −3741 | −2984 | −2024 | 2418 | −2475 | −2826 | −1361 | −1555 | −2705 | −3513 | −3509 | 133 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 128(G) | −2594 | −2690 | −3304 | −3623 | −4328 | 3747 | −3462 | −4761 | −3953 | −4671 | −4212 | −3320 | −3352 | −3748 | −3779 | −2839 | −2981 | −4004 | −3668 | −4222 | 134 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 129(C) | −2476 | 5735 | −4102 | −4358 | −3712 | −2763 | −3545 | −3518 | −4167 | −3859 | −3569 | −3631 | −3363 | −4030 | −3832 | −2793 | −2860 | −3158 | −3464 | −3718 | 135 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 130(D) | −2784 | −3432 | 4016 | −1200 | −4140 | −2466 | −2197 | −4505 | −2621 | −4365 | −3956 | −1551 | −3014 | −2039 | −3232 | −2593 | −2938 | −4046 | −3710 | −3552 | 136 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 131(K) | −2620 | −2961 | −2461 | −2046 | −3743 | −2791 | −1570 | −3603 | 3784 | −3387 | −2839 | −2048 | −3039 | −1260 | −465 | −2604 | −2536 | −3331 | −3001 | −2988 | 137 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 132(N) | −2171 | −2655 | −1458 | −1748 | −3334 | −2364 | −2267 | −3943 | −2365 | −3936 | −3437 | 4205 | −2932 | −2205 | −2608 | −2224 | −2439 | −3392 | −3253 | −2909 | 138 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 133(M) | −2406 | −2296 | −3638 | −3594 | −1525 | −3105 | −2824 | −1047 | −3121 | −596 | 5043 | −3293 | −3425 | −3046 | −2996 | −2911 | −2552 | −1398 | −2513 | −2207 | 139 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |
| 134(P) | −2931 | −2878 | −3420 | −3706 | −4181 | −2925 | −3468 | −4621 | −3859 | −4490 | −4165 | −3491 | 4225 | −3781 | −3695 | −3182 | −3279 | −4087 | −3594 | −4064 | 140 |
| — | −149 | −500 | 233 | 43 | −381 | 399 | 106 | −626 | 210 | −466 | −720 | 275 | 394 | 45 | 96 | 359 | 117 | −369 | −294 | −249 | |
| — | −16 | −7108 | −8150 | −894 | −1115 | −701 | −1378 | * | * | | | | | | | | | | | | |

TABLE 7-continued

| | | | | | | | | | | | | | | | | |
|---|---|---|---|---|---|---|---|---|---|---|---|---|---|---|---|---|
| 135(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 141 |
| 136(A) | 2180 -149 -16 | -935 -500 -7108 | -2286 233 -8150 | -2196 43 -894 | -3057 -381 -1115 | 1098 399 -701 | -2058 106 -1378 | -2796 -626 * | -2174 210 * | -3021 -466 | -2134 -720 | -1516 275 | -1898 394 | -1906 45 | -2302 96 | 2146 359 | -689 117 | -1849 -369 | -3226 -294 | -2983 -249 | 142 |
| 137(M) | -1799 -149 -16 | -1433 -500 -7108 | -4142 233 -8150 | -3579 43 -894 | -669 -381 -1115 | -3668 399 -701 | -2608 106 -1378 | 1558 -626 * | -3293 210 * | 1235 -466 | 3799 -720 | -3296 275 | -3401 394 | -2717 45 | -3088 96 | -2843 359 | -1726 117 | 1156 -369 | -2002 -294 | -1868 -249 | 143 |
| 138(I) | -2091 -149 -16 | -1746 -500 -7108 | -3971 233 -8150 | -3840 43 -894 | -1676 -381 -1115 | -3532 399 -701 | -3289 106 -1378 | 3684 -626 * | -3581 210 * | -659 -466 | -693 -720 | -3562 275 | -3674 394 | -3445 45 | -3521 96 | -3194 359 | -2146 117 | 449 -369 | -2877 -294 | -2493 -249 | 144 |
| 139(A) | 3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 145 |
| 140(M) | -2325 -149 -16 | -1891 -500 -7108 | -4598 233 -8150 | -4012 43 -894 | -498 -381 -1115 | -4222 399 -701 | -3013 106 -1378 | 1242 -626 * | -3722 210 * | 1864 -466 | 3929 -720 | -3855 275 | -3711 394 | -2910 45 | -3414 96 | -3439 359 | -2215 117 | -299 -369 | -2076 -294 | -2098 -249 | 146 |
| 141(A) | 3103 -149 -16 | -1036 -500 -7108 | -2445 233 -8150 | -2572 43 -894 | -3222 -381 -1115 | 1051 399 -701 | -2380 106 -1378 | -2930 -626 * | -2650 210 * | -3226 -466 | -2381 -720 | -1739 275 | -2034 394 | -2327 45 | -2648 96 | -664 359 | -857 117 | -1981 -369 | -3412 -294 | -3228 -249 | 147 |
| 142(R) | -1588 -149 -16 | -2442 -500 -7108 | -1399 233 -8150 | -953 43 -894 | -3069 -381 -1115 | -2171 399 -701 | -708 106 -1378 | -2795 -626 * | 373 210 * | -2625 -466 | -1916 -720 | 1858 275 | -2357 394 | -324 45 | 3294 96 | -1520 359 | -1505 117 | -2453 -369 | -2523 -294 | -2186 -249 | 148 |
| 143(M) | -1448 -149 -16 | -1256 -500 -7108 | -3396 233 -8150 | -2819 43 -894 | -474 -381 -1115 | -3024 399 -701 | -1923 106 -1378 | 175 -626 * | -2473 210 * | 2225 -466 | 2756 -720 | -2574 275 | -2922 394 | -2063 45 | -2375 96 | -2153 359 | 952 117 | -151 -369 | -1599 -294 | -1410 -249 | 149 |
| 144(N) | -1662 -149 -16 | -3306 -500 -7108 | 2055 233 -8150 | 78 43 -894 | -3621 -381 -1115 | -1643 399 -701 | -1040 106 -1378 | -3622 -626 * | -1272 210 * | -3531 -466 | -2870 -720 | 3477 275 | -2182 394 | -724 45 | -2071 96 | -1371 359 | -1757 117 | -3092 -369 | -3633 -294 | -2700 -249 | 150 |
| 145(I) | -1066 -149 -16 | -921 -500 -7108 | -2828 233 -8150 | -2239 43 -894 | -1041 -381 -1115 | -2675 399 -701 | -1601 106 -1378 | 2235 -626 * | -1668 210 * | -455 -466 | -92 -720 | -2067 275 | -2692 394 | -1688 45 | 1701 96 | -1795 359 | -1024 117 | 1960 -369 | -1771 -294 | -1396 -249 | 151 |
| 146(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 152 |
| 147(S) | 1568 -149 -16 | -940 -500 -7108 | -2267 233 -8150 | -2192 43 -894 | -3082 -381 -1115 | 1101 399 -701 | -2068 106 -1378 | -2826 -626 * | -2185 210 * | -3049 -466 | -2159 -720 | -1515 275 | -1901 394 | -1915 45 | -2313 96 | 2603 359 | -694 117 | -1866 -369 | -3279 -294 | -3006 -249 | 153 |
| 148(I) | -1880 -149 -16 | -1492 -500 -7108 | -4195 233 -8150 | -3728 43 -894 | -963 -381 -1115 | -3841 399 -701 | -2991 106 -1378 | 3272 -626 * | -3425 210 * | 246 -466 | 2277 -720 | -3490 275 | -3613 394 | -3014 45 | -3317 96 | -3092 359 | -1841 117 | 628 -369 | -2385 -294 | -2163 -249 | 154 |
| 149(F) | -2204 -149 -16 | -1797 -500 -7108 | -3724 233 -8150 | -3473 43 -894 | 3206 -381 -1115 | -3383 399 -701 | -628 106 -1378 | -1077 -626 * | -3092 210 * | -746 -466 | 3167 -720 | -2502 275 | -3309 394 | -2372 45 | -2792 96 | -2535 359 | -2120 117 | -1245 -369 | 28 -294 | 2460 -249 | 155 |
| 150(V) | 1265 -149 -16 | -1028 -500 -7108 | -3200 233 -8150 | -2994 43 -894 | -1833 -381 -1115 | -2150 399 -701 | -2480 106 -1378 | 417 -626 * | -2771 210 * | -1122 -466 | -818 -720 | -2349 275 | -2640 394 | -2559 45 | -2766 96 | -1464 359 | -1118 117 | 3028 -369 | -2700 -294 | -2325 -249 | 156 |
| 151(Y) | -3482 -149 -16 | -2868 -500 -7108 | -3701 233 -8150 | -3919 43 -894 | 238 -381 -1115 | -3552 399 -701 | -1112 106 -1378 | -3000 -626 * | -3638 210 * | -2516 -466 | -2526 -720 | -3027 275 | -3772 394 | -3101 45 | -3341 96 | -3418 359 | -3527 117 | -3071 -369 | -441 -294 | 4711 -249 | 157 |

TABLE 7-continued

| | | | | | | | | | | | | | | | | |
|---|---|---|---|---|---|---|---|---|---|---|---|---|---|---|---|---|
| 152(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 158 |
| 153(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 159 |
| 154(T) | −359 −149 −16 | −976 −500 −7108 | −2225 233 −8150 | −2229 43 −894 | −2900 −381 −1115 | −1242 399 −701 | −2074 106 −1378 | −2560 −626 * | −2170 210 * | −2875 −466 | −2064 −720 | −1561 275 | −1958 394 | −1969 45 | −2247 96 | 1110 359 | 3375 117 | −1760 −369 | −3152 −294 | −2850 −249 | 160 |
| 155(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 161 |
| 156(H) | 861 −149 −16 | −1924 −500 −7108 | −384 233 −8150 | 1010 43 −894 | −2260 −381 −1115 | −1477 399 −701 | 1787 106 −1378 | −1974 −626 * | 1769 210 * | −1918 −466 | −1022 −720 | −120 275 | −1566 394 | 362 45 | 697 96 | −417 359 | −459 117 | −1557 −369 | −2073 −294 | −1446 −249 | 162 |
| 157(P) | −655 −149 −16 | −1502 −500 −7108 | −711 233 −8150 | −557 43 −894 | −2204 −381 −1115 | −1463 399 −701 | 2143 106 −1378 | −2122 −626 * | −586 210 * | −2233 −466 | −1445 −720 | −688 275 | 2941 394 | −560 45 | −941 96 | 855 359 | −805 117 | −1657 −369 | −2369 −294 | −1763 −249 | 163 |
| 158(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 164 |
| 159(H) | −744 −149 −16 | −2193 −500 −7108 | −114 233 −8150 | 1118 43 −894 | −2513 −381 −1115 | −1512 399 −701 | 2486 106 −1378 | −2252 −626 * | 1178 210 * | −2183 −466 | −1308 −720 | 2230 275 | −1689 394 | 180 45 | −233 96 | −598 359 | −687 117 | −1823 −369 | −2335 −294 | −1670 −249 | 165 |
| 160(W) | −2672 −149 −16 | −2139 −500 −7108 | −3850 233 −8150 | −3748 43 −894 | 941 −381 −1115 | −3611 399 −701 | −469 106 −1378 | −1691 −626 * | −3306 210 * | 1047 −466 | −1217 −720 | −2551 275 | −3534 394 | −2514 45 | −2960 96 | −2788 359 | −2577 117 | −1799 −369 | 4205 −294 | 3466 −249 | 166 |
| 161(K) | 386 −149 −16 | −1981 −500 −7108 | 779 233 −8150 | 279 43 −894 | −2295 −381 −1115 | −1403 399 −701 | −114 106 −1378 | −2043 −626 * | 2059 210 * | −1991 −466 | −1082 −720 | 941 275 | −1536 394 | 1263 45 | −211 96 | −384 359 | −457 117 | −1602 −369 | −2161 −294 | −1476 −249 | 167 |
| 162(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 168 |
| 163(K) | −1144 −149 −16 | −2365 −500 −7108 | −912 233 −8150 | 2048 43 −894 | −2856 −381 −1115 | −1912 399 −701 | −326 106 −1378 | −2459 −626 * | 2267 210 * | −2295 −466 | −1482 −720 | −556 275 | −1989 394 | 108 45 | 1334 96 | −1013 359 | −1014 117 | −2093 −369 | −2324 −294 | −1881 −249 | 169 |
| 164(D) | −1091 −149 −16 | −2610 −500 −7108 | 2941 233 −8150 | 174 43 −894 | −2957 −381 −1115 | −1527 399 −701 | −595 106 −1378 | −2750 −626 * | 1084 210 * | −2696 −466 | −1877 −720 | −176 275 | −1885 394 | −206 45 | −1006 96 | 740 359 | −1098 117 | −2288 −369 | −2880 −294 | −2105 −249 | 170 |
| 165(L) | −2387 −149 −16 | −1922 −500 −7108 | −4674 233 −8150 | −4155 43 −894 | −617 −381 −1115 | −4366 399 −701 | −3250 106 −1378 | 1889 −626 * | −3865 210 * | 2650 −466 | 558 −720 | −4023 275 | −3847 394 | −3098 45 | −3586 96 | −3647 359 | −2296 117 | −38 −369 | −2247 −294 | −2224 −249 | 171 |
| 166(N) | −1021 −149 −16 | −2427 −500 −7108 | 1806 233 −8150 | 133 43 −894 | −2870 −381 −1115 | −1499 399 −701 | −635 106 −1378 | −2647 −626 * | −521 210 * | −2640 −466 | −1825 −720 | 2171 275 | −1874 394 | −255 45 | −1124 96 | −860 359 | 2122 117 | −2184 −369 | −2853 −294 | −2090 −249 | 172 |
| 167(I) | −1830 −149 −16 | −1390 −500 −7108 | −4327 233 −8150 | −3873 43 −894 | −1210 −381 −1115 | −3994 399 −701 | −3274 106 −1378 | 2967 −626 * | −3678 210 * | 1259 −466 | −30 −720 | −3633 275 | −3730 394 | −3283 45 | −3604 96 | −3249 359 | −1791 117 | 1570 −369 | −2661 −294 | −2417 −249 | 173 |
| 168(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 174 |

TABLE 7-continued

| | | | | | | | | | | | | | | | | | | | |
|---|---|---|---|---|---|---|---|---|---|---|---|---|---|---|---|---|---|---|---|
| 169(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 175 |
| 170(A) | 2440 −149 −16 | −824 −500 −7108 | −2371 233 −8150 | −2082 43 −894 | −1993 −381 −1115 | −1344 399 −701 | −1704 106 −1378 | −1264 −626 * | −1899 210 * | −1832 −466 | −1137 −720 | −1517 275 | −1946 394 | −1674 45 | −2005 96 | 1075 359 | −641 117 | 1474 −369 | −2390 −294 | −2055 −249 | 176 |
| 171(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 177 |
| 172(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 178 |
| 173(A) | 2966 −149 −16 | −1031 −500 −7108 | −2429 233 −8150 | −2551 43 −894 | −3222 −381 −1115 | 1544 399 −701 | −2368 106 −1378 | −2934 −626 * | −2633 210 * | −3225 −466 | −2377 −720 | −1727 275 | −2028 394 | −2309 45 | −2637 96 | −656 359 | −850 117 | −1980 −369 | −3412 −294 | −3224 −249 | 179 |
| 174(V) | −1769 −149 −16 | −1342 −500 −7108 | −4255 233 −8150 | −3793 43 −894 | −1216 −381 −1115 | −3901 399 −701 | −3162 106 −1378 | 1633 −626 * | −3589 210 * | 1486 −466 | −51 −720 | −3537 275 | −3667 394 | −3214 45 | −3518 96 | −3143 359 | −1731 117 | 2692 −369 | −2609 −294 | −2345 −249 | 180 |
| 175(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 181 |
| 176(Q) | −729 −149 −16 | −2116 −500 −7108 | −413 233 −8150 | 1096 43 −894 | −2484 −381 −1115 | −1587 399 −701 | 1599 106 −1378 | −2186 −626 * | 1695 210 * | −2094 −466 | −1219 −720 | −223 275 | −1698 394 | 2418 45 | 90 96 | −599 359 | −649 117 | −1770 −369 | −2213 −294 | −1615 −249 | 182 |
| 177(W) | −1652 −149 −16 | −1707 −500 −7108 | −2340 233 −8150 | −1879 43 −894 | 1996 −381 −1115 | −2733 399 −701 | 2013 106 −1378 | −1398 −626 * | 1758 210 * | −1386 −466 | −938 −720 | −1641 275 | −2751 394 | −1364 45 | −1762 96 | −1780 359 | −1577 117 | −1325 −369 | 3577 −294 | 2136 −249 | 183 |
| 178(T) | −421 −149 −16 | −753 −500 −7108 | −1251 233 −8150 | −704 43 −894 | −846 −381 −1115 | −1670 399 −701 | −535 106 −1378 | 894 −626 * | −548 210 * | −690 −466 | −1 −720 | 1376 275 | −1791 394 | −421 45 | −846 96 | 373 359 | 1461 117 | 858 −369 | −1236 −294 | −812 −249 | 184 |
| 179(H) | 1498 −149 −16 | −1593 −500 −7108 | −504 233 −8150 | 15 43 −894 | −1895 −381 −1115 | −1484 399 −701 | 2279 106 −1378 | −1559 −626 * | 1119 210 * | −1640 −466 | −810 −720 | −242 275 | −1611 394 | 194 45 | −171 96 | −462 359 | 815 117 | −1231 −369 | −1914 −294 | −1340 −249 | 185 |
| 180(G) | −1515 −149 −16 | −2130 −500 −7108 | −1298 233 −8150 | −1450 43 −894 | −2658 −381 −1115 | 3285 399 −701 | 2212 106 −1378 | −3276 −626 * | −1691 210 * | −3291 −466 | −2638 −720 | −1524 275 | −2562 394 | −1662 45 | −1925 96 | −1600 359 | −1764 117 | −2713 −369 | −2804 −294 | −2234 −249 | 186 |
| 181(K) | −528 −149 −16 | −2010 −500 −7108 | 1346 233 −8150 | 1082 43 −894 | −2329 −381 −1115 | −1408 399 −701 | −118 106 −1378 | −2080 −626 * | 1475 210 * | −2018 −466 | −1108 −720 | 1161 275 | −1543 394 | 331 45 | 1052 96 | −394 359 | −471 117 | −1632 −369 | −2181 −294 | −1494 −249 | 187 |
| 182(M) | −1894 −149 −16 | −1521 −500 −7108 | −4170 233 −8150 | −3679 43 −894 | −840 −381 −1115 | −3793 399 −701 | −2866 106 −1378 | 2827 −626 * | −3360 210 * | 375 −466 | 3445 −720 | −3437 275 | −3555 394 | −2902 45 | −3223 96 | −3028 359 | −1846 117 | 470 −369 | −2249 −294 | −2059 −249 | 188 |
| 183(T) | −670 −149 −16 | −1758 −500 −7108 | 1731 233 −8150 | −141 43 −894 | −2591 −381 −1115 | −1399 399 −701 | −691 106 −1378 | −2319 −626 * | −499 210 * | −2384 −466 | −1543 −720 | −387 275 | −1786 394 | −316 45 | −1016 96 | 1576 359 | 2044 117 | −1811 −369 | −2624 −294 | −1981 −249 | 189 |
| 184(E) | 345 −149 −16 | −2074 −500 −7108 | 925 233 −8150 | 1994 43 −894 | −2378 −381 −1115 | −1408 399 −701 | −177 106 −1378 | −2135 −626 * | 922 210 * | −2084 −466 | −1183 −720 | −38 275 | 641 394 | 264 45 | −356 96 | −444 359 | −536 117 | −1690 −369 | −2261 −294 | −1556 −249 | 190 |
| 185(E) | −1493 −149 −16 | −2900 −500 −7108 | 93 233 −8150 | 3174 43 −894 | −2903 −381 −1115 | −1743 399 −701 | 1987 106 −1378 | −3042 −626 * | −646 210 * | −2957 −466 | −2238 −720 | −411 275 | −2146 394 | −506 45 | −1121 96 | −1272 359 | −1503 117 | −2629 −369 | −2905 −294 | −2134 −249 | 191 |

TABLE 7-continued

| | | | | | | | | | | | | | | | | | |
|---|---|---|---|---|---|---|---|---|---|---|---|---|---|---|---|---|---|
| 186(D) | −1293 −149 −16 | −2959 −500 −7108 | 2673 233 −8150 | 2121 43 −894 | −3219 −381 −1115 | −1546 399 −701 | −713 106 −1378 | −3043 −626 * | −707 210 * | −2974 −466 | −2191 −720 | −158 275 | −1967 394 | −342 45 | −1394 96 | −1043 359 | 701 117 | −2567 −369 | −3172 −294 | −2311 −249 | 192 |
| 187(F) | −1137 −149 −16 | −905 −500 −7108 | −3250 233 −8150 | −2707 43 −894 | 2365 −381 −1115 | −2647 399 −701 | −1016 106 −1378 | −34 −626 * | −2336 210 * | 1239 −466 | 267 −720 | −2150 275 | −2626 394 | −1861 45 | −2133 96 | −1752 359 | −1069 117 | 1461 −369 | −599 −294 | 1844 −249 | 193 |
| 188(K) | −479 −149 −16 | −1713 −500 −7108 | −409 233 −8150 | 1031 43 −894 | −1925 −381 −1115 | −1467 399 −701 | 1755 106 −1378 | −1650 −626 * | 1844 210 * | −349 −466 | −827 −720 | −140 275 | −1556 394 | 319 45 | −75 96 | −403 359 | −411 117 | −1301 −369 | −1900 −294 | 843 −249 | 194 |
| 189(G) | 433 −149 −16 | −2144 −500 −7108 | 52 233 −8150 | 1047 43 −894 | −2717 −381 −1115 | 2303 399 −701 | −615 106 −1378 | −2467 −626 * | −442 210 * | −2482 −466 | −1655 −720 | 1123 275 | −1828 394 | −233 45 | −995 96 | −763 359 | −923 117 | −2000 −369 | −2710 −294 | −2005 −249 | 195 |
| 190(V) | −1752 −149 −16 | −1320 −500 −7108 | −4254 233 −8150 | −3806 43 −894 | −1311 −381 −1115 | −3916 399 −701 | −3232 106 −1378 | 1701 −626 * | −3614 210 * | 1188 −466 | −140 −720 | −3551 275 | −3693 394 | −3280 45 | −3568 96 | −3166 359 | −1718 117 | 2833 −369 | −2703 −294 | −2409 −249 | 196 |
| 191(E) | −1199 −149 −16 | −1750 −500 −7108 | −734 233 −8150 | 2668 43 −894 | −1820 −381 −1115 | −2038 399 −701 | −1068 106 −1378 | 1892 −626 * | −867 210 * | −1273 −466 | −897 −720 | −922 275 | −2295 394 | −797 45 | −1238 96 | −1340 359 | −1197 117 | −426 −369 | −2325 −294 | −1789 −249 | 197 |
| 192(C) | −1182 −149 −16 | 3528 −500 −7108 | −1398 233 −8150 | −620 43 −894 | −2541 −381 −1115 | −2038 399 −701 | −358 106 −1378 | −2093 −626 * | 1181 210 * | −2037 −466 | −1272 −720 | −747 275 | −2070 394 | 1553 45 | 2213 96 | −1123 359 | −1038 117 | −1817 −369 | −2142 −294 | −1774 −249 | 198 |
| 193(N) | −1478 −149 −16 | −2527 −500 −7108 | −261 233 −8150 | −403 43 −894 | −2011 −381 −1115 | −1837 399 −701 | 2032 106 −1378 | −2925 −626 * | −735 210 * | −2845 −466 | −2195 −720 | 3635 275 | −2259 394 | −721 45 | −1085 96 | −1352 359 | −1546 117 | −2522 −369 | −2307 −294 | −1431 −249 | 199 |
| 194(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 200 |
| 195(C) | −1220 −149 −16 | 4911 −500 −7108 | −3609 233 −8150 | −3314 43 −894 | −1440 −381 −1115 | −2525 399 −701 | −2482 106 −1378 | 1565 −626 * | −2922 210 * | −706 −466 | −544 −720 | −2678 275 | −2896 394 | −2710 45 | −2836 96 | −1869 359 | −1375 117 | 379 −369 | −2371 −294 | −1957 −249 | 201 |
| 196(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 202 |
| 197(G) | −477 −149 −16 | −1115 −500 −7108 | −1983 233 −8150 | −2189 43 −894 | −3315 −381 −1115 | 3154 399 −701 | −2272 106 −1378 | −3172 −626 * | −2506 210 * | −3387 −466 | −2522 −720 | −1599 275 | −2042 394 | −2177 45 | −2583 96 | 1217 359 | −905 117 | −2130 −369 | −3477 −294 | −3225 −249 | 203 |
| 198(A) | 1653 −149 −16 | −1347 −500 −7108 | −705 233 −8150 | −249 43 −894 | −1969 −381 −1115 | −1385 399 −701 | −477 106 −1378 | −1629 −626 * | −159 210 * | −1759 −466 | −935 −720 | −434 275 | 1285 394 | 1404 45 | −586 96 | −450 359 | 1019 117 | −1243 −369 | −2070 −294 | −1522 −249 | 204 |
| 199(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 205 |
| 200(S) | 1870 −149 −16 | −938 −500 −7108 | −2270 233 −8150 | −2183 43 −894 | −3068 −381 −1115 | 1488 399 −701 | −2056 106 −1378 | −2810 −626 * | −2168 210 * | −3032 −466 | −2144 −720 | −1511 275 | −1898 394 | −1901 45 | −2300 96 | 2236 359 | −690 117 | −1857 −369 | −3265 −294 | −2990 −249 | 206 |
| 201(C) | −2476 −149 −16 | 5735 −500 −7108 | −4102 233 −8150 | −4358 43 −894 | −3712 −381 −1115 | −2763 399 −701 | −3545 106 −1378 | −3518 −626 * | −4167 210 * | −3859 −466 | −3569 −720 | −3631 275 | −3363 394 | −4030 45 | −3832 96 | −2793 359 | −2860 117 | −3158 −369 | −3464 −294 | −3718 −249 | 207 |
| 202(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 208 |

TABLE 7-continued

| | | | | | | | | | | | | | | | | | | |
|---|---|---|---|---|---|---|---|---|---|---|---|---|---|---|---|---|---|---|
| 203(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 209 |
| 204(M) | −2406 −149 −16 | −2296 −500 −7108 | −3638 233 −8150 | −3594 43 −894 | −1525 −381 −1115 | −3105 399 −701 | −2824 106 −1378 | −1047 −626 * | −3121 210 * | −596 −466 | 5043 −720 | −3293 275 | −3425 394 | −3046 45 | −2996 96 | −2911 359 | −2552 117 | −1398 −369 | −2513 −294 | −2207 −249 | 210 |
| 205(Y) | −3590 −149 −16 | −2700 −500 −7108 | −4146 233 −8150 | −4379 43 −894 | 2092 −381 −1115 | −4028 399 −701 | −404 106 −1378 | −2517 −626 * | −3963 210 * | −1928 −466 | −1973 −720 | −2744 275 | −3921 394 | −2845 45 | −3431 96 | −3284 359 | −3474 117 | −2669 −369 | 336 −294 | 4423 −249 | 211 |
| 206(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 212 |
| 207(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 213 |
| 208(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 214 |
| 209(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 215 |
| 210(M) | −2355 −149 −16 | −1988 −500 −7108 | −4343 233 −8150 | −3834 43 −894 | −504 −381 −1115 | −4051 399 −701 | −2868 106 −1378 | 105 −626 * | −3385 210 * | 1451 −466 | 4460 −720 | −3680 275 | −3671 394 | −2806 45 | −3171 96 | −3327 359 | −2274 117 | −474 −369 | −2039 −294 | −1925 −249 | 216 |
| 211(S) | 2150 −149 −16 | −939 −500 −7108 | −2407 233 −8150 | −2415 43 −894 | −3075 −381 −1115 | −1197 399 −701 | −2205 106 −1378 | −2781 −626 * | −2384 210 * | −3065 −466 | −2205 −720 | −1613 275 | −1936 394 | −2105 45 | −2436 96 | 2652 359 | −729 117 | −1850 −369 | −3306 −294 | −3049 −249 | 217 |
| 212(S) | −344 −149 −16 | −979 −500 −7108 | −2190 233 −8150 | −2162 43 −894 | −2959 −381 −1115 | −1227 399 −701 | −2042 106 −1378 | −2651 −626 * | −2116 210 * | −2934 −466 | −2100 −720 | −1526 275 | −1941 394 | −1909 45 | −2222 96 | 2940 359 | 1775 117 | −1804 −369 | −3187 −294 | −2882 −249 | 218 |
| 213(A) | 3048 −149 −16 | −932 −500 −7108 | −2480 233 −8150 | −2533 43 −894 | −3075 −381 −1115 | −1200 399 −701 | −2274 106 −1378 | −2765 −626 * | −2501 210 * | −3071 −466 | −2221 −720 | −1658 275 | −1948 394 | −2205 45 | −2512 96 | 1225 359 | −739 117 | −1842 −369 | −3322 −294 | −3078 −249 | 219 |
| 214(I) | −1924 −149 −16 | −1546 −500 −7108 | −4067 233 −8150 | −3658 43 −894 | 2312 −381 −1115 | −3663 399 −701 | −2081 106 −1378 | 3030 −626 * | −3367 210 * | 150 −466 | 99 −720 | −3197 275 | −3492 394 | −2821 45 | −3179 96 | −2894 359 | −1877 117 | 293 −369 | −1445 −294 | −692 −249 | 220 |
| 215(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 221 |
| 216(A) | 2389 −149 −16 | −814 −500 −7108 | −2506 233 −8150 | −2162 43 −894 | −1696 −381 −1115 | −1545 399 −701 | −1698 106 −1378 | −499 −626 * | −1942 210 * | −1398 −466 | −813 −720 | −1640 275 | −2076 394 | −1723 45 | −2027 96 | −806 359 | 1148 117 | 1559 −369 | −2200 −294 | −1856 −249 | 222 |
| 217(M) | −2576 −149 −16 | −2118 −500 −7108 | −4725 233 −8150 | −4165 43 −894 | 461 −381 −1115 | −4430 399 −701 | −3165 106 −1378 | 99 −626 * | −3811 210 * | 2513 −466 | 3454 −720 | −4075 275 | −3839 394 | −2978 45 | −3488 96 | −3704 359 | −2457 117 | −591 −369 | −2111 −294 | −2145 −249 | 223 |
| 218(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 224 |
| 219(M) | −2313 −149 −16 | −1968 −500 −7108 | −4258 233 −8150 | −3765 43 −894 | −518 −381 −1115 | −3966 399 −701 | −2806 106 −1378 | 98 −626 * | −3289 210 * | 1292 −466 | 4523 −720 | −3599 275 | −3636 394 | −2769 45 | −3097 96 | −3249 359 | −2243 117 | −457 −369 | −2026 −294 | −1874 −249 | 225 |

TABLE 7-continued

| | | | | | | | | | | | | | | | | |
|---|---|---|---|---|---|---|---|---|---|---|---|---|---|---|---|---|
| 220(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 226 |
| 221(L) | −2631 −149 −16 | −2159 −500 −7108 | −4786 233 −8150 | −4228 43 −894 | −462 −381 −1115 | −4506 399 −701 | −3231 106 −1378 | 96 −626 * | −3878 210 * | 2828 −466 | 2482 −720 | −4157 275 | −3880 394 | −3016 45 | −3541 96 | −3793 359 | −2509 117 | −608 −369 | −2134 −294 | −2182 −249 | 227 |
| 222(P) | −1501 −149 −16 | −1778 −500 −7108 | −2473 233 −8150 | −2371 43 −894 | −1710 −381 −1115 | −2311 399 −701 | −2045 106 −1378 | −1321 −626 * | −2060 210 * | 827 −466 | −1068 −720 | −2173 275 | 3594 394 | −2082 45 | −2130 96 | −1799 359 | −1699 117 | −1373 −369 | −2373 −294 | −1942 −249 | 228 |
| 223(Y) | −1068 −149 −16 | −1670 −500 −7108 | −865 233 −8150 | −836 43 −894 | −631 −381 −1115 | 1198 399 −701 | −767 106 −1378 | −1828 −626 * | −1059 210 * | −1914 −466 | −1304 −720 | 692 275 | −2203 394 | −906 45 | −1387 96 | −1136 359 | −1163 117 | −1566 −369 | −1185 −294 | 3670 −249 | 229 |
| 224(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 230 |
| 225(S) | 1172 −149 −16 | −954 −500 −7108 | −2367 233 −8150 | −2422 43 −894 | −3120 −381 −1115 | −1204 399 −701 | −2237 106 −1378 | −2835 −626 * | −2426 210 * | −3122 −466 | −2265 −720 | −1621 275 | −1948 394 | −2145 45 | −2467 96 | 3107 359 | −749 117 | −1884 −369 | −3349 −294 | −3092 −249 | 231 |
| 226(S) | −342 −149 −16 | −975 −500 −7108 | −2176 233 −8150 | −2124 43 −894 | −2912 −381 −1115 | −1229 399 −701 | −2003 106 −1378 | −2594 −626 * | −2067 210 * | −2878 −466 | −2048 −720 | −1510 275 | −1936 394 | −1866 45 | −2184 96 | 2553 359 | 2492 117 | −1773 −369 | −3143 −294 | −2833 −249 | 232 |
| 227(M) | −720 −149 −16 | −1440 −500 −7108 | −710 233 −8150 | −343 43 −894 | −1228 −381 −1115 | −1693 399 −701 | 2436 106 −1378 | −1209 −626 * | −132 210 * | −1364 −466 | 3099 −720 | 1904 275 | −1852 394 | −183 45 | −458 96 | −776 359 | −680 117 | −1004 −369 | −1540 −294 | −890 −249 | 233 |
| 228(P) | 2240 −149 −16 | −1100 −500 −7108 | −2241 233 −8150 | −2293 43 −894 | −3037 −381 −1115 | −1346 399 −701 | −2188 106 −1378 | −2683 −626 * | −2317 210 * | −2986 −466 | −2210 −720 | −1663 275 | 3041 394 | −2093 45 | −2391 96 | −722 359 | −895 117 | −1893 −369 | −3243 −294 | −2998 −249 | 234 |
| 229(A) | 2958 −149 −16 | −1235 −500 −7108 | −1299 233 −8150 | −1377 43 −894 | −2868 −381 −1115 | −1345 399 −701 | −1673 106 −1378 | −2580 −626 * | −1661 210 * | −2843 −466 | −2054 −720 | 1555 275 | −1995 394 | −1468 45 | −1921 96 | −715 359 | −888 117 | −1871 −369 | −3064 −294 | −2630 −249 | 235 |
| 230(E) | −509 −149 −16 | −1046 −500 −7108 | −884 233 −8150 | 1564 43 −894 | −1116 −381 −1115 | −1669 399 −701 | −441 106 −1378 | −485 −626 * | −283 210 * | 250 −466 | −206 −720 | −577 275 | 689 394 | −200 45 | −656 96 | −670 359 | −459 117 | 1290 −369 | −1467 −294 | −995 −249 | 236 |
| 231(D) | −1203 −149 −16 | −2412 −500 −7108 | 2595 233 −8150 | −117 43 −894 | −3286 −381 −1115 | −1536 399 −701 | −1057 106 −1378 | −3176 −626 * | −1165 210 * | −3186 −466 | −2436 −720 | −428 275 | −2068 394 | −736 45 | −1824 96 | 2377 359 | −1366 117 | −2578 −369 | −3334 −294 | −2552 −249 | 237 |
| 232(Q) | 954 −149 −16 | −1983 −500 −7108 | −100 233 −8150 | 971 43 −894 | −2337 −381 −1115 | 177 399 −701 | −267 106 −1378 | −2067 −626 * | 81 210 * | −2060 −466 | −1189 −720 | −125 275 | −1637 394 | 2600 45 | −418 96 | −514 359 | −597 117 | −1649 −369 | −2268 −294 | −1597 −249 | 238 |
| 233(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 239 |
| 234(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 240 |
| 235(R) | 377 −149 −16 | −1802 −500 −7108 | −415 233 −8150 | 988 43 −894 | −2095 −381 −1115 | −1474 399 −701 | −95 106 −1378 | −1786 −626 * | 1452 210 * | −1785 −466 | −911 −720 | −135 275 | −1560 394 | 343 45 | 1555 96 | −409 359 | −431 117 | 376 −369 | −1986 −294 | −1375 −249 | 241 |
| 236(D) | 1083 −149 −16 | −1565 −500 −7108 | 2662 233 −8150 | −244 43 −894 | −1941 −381 −1115 | −1573 399 −701 | −679 106 −1378 | 612 −626 * | −527 210 * | −1651 −466 | −980 −720 | −490 275 | −1869 394 | −358 45 | −1003 96 | −771 359 | −766 117 | −903 −369 | −2208 −294 | −1633 −249 | 242 |

TABLE 7-continued

| | | | | | | | | | | | | | | | | | |
|---|---|---|---|---|---|---|---|---|---|---|---|---|---|---|---|---|---|
| 237(E) | −1225 −149 −16 | −2868 −500 −7108 | 1894 233 −8150 | 1948 43 −894 | −3149 −381 −1115 | −1532 399 −701 | −671 106 −1378 | −2975 −626 * | −630 210 * | −2902 −466 | −2101 −720 | −150 275 | −1935 394 | −293 45 | −1299 96 | 1884 359 | −1241 117 | −2496 −369 | −3093 −294 | −2248 −249 | 243 |
| 238(C) | 1375 −149 −16 | 3262 −500 −7108 | −2620 233 −8150 | −2108 43 −894 | −827 −381 −1115 | −1866 399 −701 | −1267 106 −1378 | 1631 −626 * | −1811 210 * | −599 −466 | −10 −720 | −1674 275 | −2137 394 | −1531 45 | −1786 96 | −1034 359 | 790 117 | 249 −369 | −1361 −294 | −1010 −249 | 244 |
| 239(E) | 635 −149 −16 | −1796 −500 −7108 | 1055 233 −8150 | 1761 43 −894 | −2018 −381 −1115 | −1464 399 −701 | −263 106 −1378 | 1191 −626 * | 28 210 * | −1767 −466 | −946 −720 | −148 275 | −1637 394 | 135 45 | −481 96 | −520 359 | −553 117 | −1300 −369 | −2077 −294 | −1441 −249 | 245 |
| 240(E) | 593 −149 −16 | −2044 −500 −7108 | −252 233 −8150 | 2548 43 −894 | −2437 −381 −1115 | −1542 399 −701 | −329 106 −1378 | −2133 −626 * | 151 210 * | −2120 −466 | −1274 −720 | −244 275 | −1738 394 | 89 45 | 946 96 | −646 359 | −717 117 | −1734 −369 | −2305 −294 | −1686 −249 | 246 |
| 241(S) | 1884 −149 −16 | −835 −500 −7108 | −1962 233 −8150 | −1576 43 −894 | −1634 −381 −1115 | −1436 399 −701 | −1320 106 −1378 | 1041 −626 * | −1409 210 * | −1453 −466 | −781 −720 | −1293 275 | −1922 394 | −1241 45 | −1606 96 | 1973 359 | −597 117 | −669 −369 | −2036 −294 | −1656 −249 | 247 |
| 242(G) | 2267 −149 −16 | −1043 −500 −7108 | −2388 233 −8150 | −2526 43 −894 | −3253 −381 −1115 | 2642 399 −701 | −2373 106 −1378 | −2975 −626 * | −2639 210 * | −3260 −466 | −2410 −720 | −1722 275 | −2033 394 | −2311 45 | −2648 96 | −663 359 | −860 117 | −2005 −369 | −3436 −294 | −3250 −249 | 248 |
| 243(R) | −876 −149 −16 | −2087 −500 −7108 | −829 233 −8150 | 1490 43 −894 | −2474 −381 −1115 | −1766 399 −701 | −229 106 −1378 | −2106 −626 * | 1269 210 * | −44 −466 | −1198 −720 | −424 275 | −1829 394 | 205 45 | 2225 96 | −775 359 | −768 117 | −1753 −369 | −2143 −294 | −1647 −249 | 249 |
| 244(V) | 2339 −149 −16 | −967 −500 −7108 | −2970 233 −8150 | −2766 43 −894 | −1878 −381 −1115 | −1847 399 −701 | −2252 106 −1378 | 32 −626 * | −2541 210 * | −1299 −466 | −918 −720 | −2087 275 | −2399 394 | −2316 45 | −2545 96 | −1157 359 | −971 117 | 2345 −369 | −2605 −294 | −2251 −249 | 250 |
| 245(I) | −1827 −149 −16 | −1398 −500 −7108 | −4307 233 −8150 | −3831 43 −894 | −1099 −381 −1115 | −3939 399 −701 | −3142 106 −1378 | 2286 −626 * | −3619 210 * | 1835 −466 | 69 −720 | −3579 275 | −3671 394 | −3177 45 | −3511 96 | −3178 359 | −1781 117 | 1918 −369 | −2524 −294 | −2310 −249 | 251 |
| 246(V) | −1178 −149 −16 | −1448 −500 −7108 | −1943 233 −8150 | −1452 43 −894 | −1776 −381 −1115 | −2261 399 −701 | −1140 106 −1378 | −227 −626 * | 1866 210 * | −1260 −466 | −816 −720 | −1444 275 | −2448 394 | −902 45 | −540 96 | −1496 359 | −1176 117 | 2697 −369 | −2161 −294 | −1764 −249 | 252 |
| 247(E) | −508 −149 −16 | −1976 −500 −7108 | 840 233 −8150 | 1547 43 −894 | −2280 −381 −1115 | −1393 399 −701 | −117 106 −1378 | −2029 −626 * | 1400 210 * | −1984 −466 | −1077 −720 | 1158 275 | −1531 394 | 330 45 | −253 96 | −378 359 | −454 117 | 262 −369 | −2163 −294 | −1471 −249 | 253 |
| 248(M) | 1703 −149 −16 | −991 −500 −7108 | −2901 233 −8150 | −2342 43 −894 | −528 −381 −1115 | −2567 399 −701 | −1550 106 −1378 | 166 −626 * | −2031 210 * | 1544 −466 | 2668 −720 | −2104 275 | −2591 394 | −1715 45 | −2010 96 | −1685 359 | −1052 117 | −12 −369 | −1442 −294 | −1177 −249 | 254 |
| 249(I) | −1947 −149 −16 | −1516 −500 −7108 | −4385 233 −8150 | −3885 43 −894 | −916 −381 −1115 | −4013 399 −701 | −3118 106 −1378 | 2193 −626 * | −3656 210 * | 2186 −466 | 257 −720 | −3656 275 | −3687 394 | −3109 45 | −3494 96 | −3250 359 | −1889 117 | 1383 −369 | −2397 −294 | −2258 −249 | 255 |
| 250(E) | −1322 −149 −16 | −2647 −500 −7108 | −272 233 −8150 | 2491 43 −894 | −3071 −381 −1115 | −1811 399 −701 | −576 106 −1378 | −2759 −626 * | 2306 210 * | −2633 −466 | −1854 −720 | −464 275 | −2066 394 | −902 45 | −540 96 | −1496 359 | −1256 117 | −2368 −369 | −2692 −294 | −2140 −249 | 256 |
| 251(K) | −1395 −149 −16 | −2059 −500 −7108 | −1711 233 −8150 | −1014 43 −894 | −2215 −381 −1115 | −2218 399 −701 | −641 106 −1378 | −1709 −626 * | 3021 210 * | −1652 −466 | 2578 −720 | −1075 275 | −2303 394 | −282 45 | 287 96 | −1423 359 | −1283 117 | −1603 −369 | −2159 −294 | −1803 −249 | 257 |
| 252(D) | −1285 −149 −16 | −2888 −500 −7108 | 2677 233 −8150 | 176 43 −894 | −3210 −381 −1115 | 1189 399 −701 | −737 106 −1378 | −3047 −626 * | −715 210 * | −2977 −466 | −2195 −720 | −190 275 | −1979 394 | 2106 45 | −1379 96 | −1050 359 | −1315 117 | −2564 −369 | −3161 −294 | −2320 −249 | 258 |
| 253(I) | −2073 −149 −16 | −1632 −500 −7108 | −4434 233 −8150 | −3975 43 −894 | −911 −381 −1115 | −4130 399 −701 | −3238 106 −1378 | 3164 −626 * | −3706 210 * | 1451 −466 | 244 −720 | −3779 275 | −3785 394 | −3187 45 | −3557 96 | −3413 359 | −2021 117 | 546 −369 | −2449 −294 | −2273 −249 | 259 |

TABLE 7-continued

| | | | | | | | | | | | | | | | | |
|---|---|---|---|---|---|---|---|---|---|---|---|---|---|---|---|---|
| 254(K) | -1570 -149 -16 | -2144 -500 -7108 | -1887 233 -8150 | -1191 43 -894 | -2098 -381 -1115 | -2363 399 -701 | -750 106 -1378 | -1603 -626 * | 3034 210 * | 938 -466 | -1112 -720 | -1231 275 | -2436 394 | -408 45 | 215 96 | -1616 359 | -1443 117 | -1580 -369 | -2166 -294 | -1804 -249 | 260 |
| 255(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 261 |
| 256(R) | -928 -149 -16 | -1705 -500 -7108 | -1507 233 -8150 | -1055 43 -894 | -2761 -381 -1115 | -1730 399 -701 | -896 106 -1378 | -2490 -626 * | -44 210 * | -2489 -466 | -1723 -720 | -1042 275 | -2102 394 | -543 45 | 2614 96 | 2258 359 | -1053 117 | -1998 -369 | -2546 -294 | -2158 -249 | 262 |
| 257(D) | -1280 -149 -16 | -2865 -500 -7108 | 3154 233 -8150 | 175 43 -894 | -3194 -381 -1115 | -1547 399 -701 | -743 106 -1378 | -3034 -626 * | -728 210 * | -2971 -466 | -2194 -720 | -190 275 | -1979 394 | 1342 45 | -1391 96 | 553 359 | -1316 117 | -2552 -369 | -3161 -294 | -2317 -249 | 263 |
| 258(I) | -1997 -149 -16 | -1562 -500 -7108 | -4355 233 -8150 | -3927 43 -894 | -1042 -381 -1115 | -4066 399 -701 | -3261 106 -1378 | 3343 -626 * | -3654 210 * | 937 -466 | 97 -720 | -3718 275 | -3783 394 | -3239 45 | -3555 96 | -3364 359 | -1959 117 | 702 -369 | -2549 -294 | -2295 -249 | 264 |
| 259(M) | -2252 -149 -16 | -1821 -500 -7108 | -4572 233 -8150 | -3991 43 -894 | -530 -381 -1115 | -4164 399 -701 | -2990 106 -1378 | 2068 -626 * | -3709 210 * | 1993 -466 | 3197 -720 | -3808 275 | -3685 394 | -2916 45 | -3406 96 | -3378 359 | -2149 117 | -172 -369 | -2084 -294 | -2091 -249 | 265 |
| 260(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 * | -3105 -466 | -2612 -720 | -2311 275 | -2600 394 | -2708 45 | -2753 96 | -1463 359 | 3819 117 | -2197 -369 | -3286 -294 | -3156 -249 | 266 |
| 261(R) | -2131 -149 -16 | -2786 -500 -7108 | -2704 233 -8150 | -1460 43 -894 | -3618 -381 -1115 | -2638 399 -701 | -887 106 -1378 | -2976 -626 * | 1735 210 * | -2645 -466 | -1985 -720 | -1353 275 | -2603 394 | -173 45 | 3492 96 | -2020 359 | -1828 117 | -2748 -369 | -2484 -294 | -2384 -249 | 267 |
| 262(K) | -1349 -149 -16 | -2635 -500 -7108 | -381 233 -8150 | 2083 43 -894 | -3083 -381 -1115 | -1857 399 -701 | -565 106 -1378 | -2750 -626 * | 2690 210 * | -2612 -466 | -1837 -720 | -514 275 | -2090 394 | -161 45 | -61 96 | -1178 359 | -1271 117 | -2369 -369 | -2655 -294 | -2138 -249 | 268 |
| 263(A) | 2821 -149 -16 | -932 -500 -7108 | -2451 233 -8150 | -2472 43 -894 | -3065 -381 -1115 | -1198 399 -701 | -2233 106 -1378 | -2763 -626 * | -2434 210 * | -3056 -466 | -2201 -720 | -1633 275 | -1940 394 | -2147 45 | -2468 96 | 1831 359 | -730 117 | -1840 -369 | -3305 -294 | -3055 -249 | 269 |
| 264(F) | -2063 -149 -16 | -1686 -500 -7108 | -4037 233 -8150 | -3677 43 -894 | 3437 -381 -1115 | -3644 399 -701 | -1706 106 -1378 | 2063 -626 * | -3359 210 * | 135 -466 | 67 -720 | -3095 275 | -3486 394 | -2739 45 | -3127 96 | -2876 359 | -2012 117 | -83 -369 | -1038 -294 | -158 -249 | 270 |
| 265(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 271 |
| 266(N) | -1662 -149 -16 | -3306 -500 -7108 | 2055 233 -8150 | 78 43 -894 | -3621 -381 -1115 | -1643 399 -701 | -1040 106 -1378 | -3622 -626 * | -1272 210 * | -3531 -466 | -2870 -720 | 3477 275 | -2182 394 | -724 45 | -2071 96 | -1371 359 | -1757 117 | -3092 -369 | -3633 -294 | -2700 -249 | 272 |
| 267(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 273 |
| 268(I) | -1760 -149 -16 | -1307 -500 -7108 | -4325 233 -8150 | -3962 43 -894 | -1735 -381 -1115 | -4042 399 -701 | -3726 106 -1378 | 3135 -626 * | -3828 210 * | -579 -466 | -515 -720 | -3722 275 | -3869 394 | -3673 45 | -3896 96 | -3359 359 | -1752 117 | 2276 -369 | -3240 -294 | -2806 -249 | 274 |
| 269(T) | 1428 -149 -16 | -904 -500 -7108 | -2334 233 -8150 | -2158 43 -894 | -2747 -381 -1115 | -1206 399 -701 | -1940 106 -1378 | -2392 -626 * | -2037 210 * | -2678 -466 | -1846 -720 | -1504 275 | -1896 394 | -1809 45 | -2163 96 | 902 359 | 3001 117 | -1635 -369 | -2999 -294 | -2705 -249 | 275 |
| 270(V) | -1745 -149 -16 | -1300 -500 -7108 | -4286 233 -8150 | -3858 43 -894 | -1446 -381 -1115 | -3967 399 -701 | -3370 106 -1378 | 2358 -626 * | -3688 210 * | 852 -466 | -261 -720 | -3606 275 | -3749 394 | -3403 45 | -3673 96 | -3232 359 | -1717 117 | 2643 -369 | -2856 -294 | -2524 -249 | 276 |

TABLE 7-continued

| | | | | | | | | | | | | | | | | | |
|---|---|---|---|---|---|---|---|---|---|---|---|---|---|---|---|---|---|
| 271(V) | −1404 −149 −16 | −1072 −500 −7108 | −3766 233 −8150 | −3305 43 −894 | −1464 −381 −1115 | −3356 399 −701 | −2696 106 −1378 | 2276 −626 * | −3080 210 * | −616 −466 | −379 −720 | −3001 275 | −3325 394 | −2870 45 | −3091 96 | −2563 359 | 1344 117 | 2521 −369 | −2516 −294 | −2113 −249 | 277 |
| 272(M) | 866 −149 −16 | −1113 −500 −7108 | −2656 233 −8150 | −2412 43 −894 | −1322 −381 −1115 | −1920 399 −701 | −1883 106 −1378 | −487 −626 * | −2061 210 * | −587 −466 | 4451 −720 | −1950 275 | −2387 394 | −1928 45 | −2078 96 | −1220 359 | −1053 117 | −498 −369 | −2134 −294 | −1803 −249 | 278 |
| 273(A) | 2601 −149 −16 | −957 −500 −7108 | −2898 233 −8150 | −2711 43 −894 | −1943 −381 −1115 | −1740 399 −701 | −2211 106 −1378 | −165 −626 * | −2487 210 * | −1406 −466 | −1001 −720 | −2008 275 | −2320 394 | −2260 45 | −2494 96 | −1053 359 | −929 117 | 1990 −369 | −2626 −294 | −2279 −249 | 279 |
| 274(L) | −1171 −149 −16 | −983 −500 −7108 | −3266 233 −8150 | −2733 43 −894 | −796 −381 −1115 | −2795 399 −701 | −1888 106 −1378 | 590 −626 * | −2418 210 * | 2001 −466 | 198 −720 | −2418 275 | −2816 394 | −2106 45 | −2362 96 | −1944 359 | 965 117 | 1777 −369 | −1724 −294 | −1426 −249 | 280 |
| 275(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 281 |
| 276(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 282 |
| 277(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 283 |
| 278(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 284 |
| 279(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 285 |
| 280(A) | 3134 −149 −16 | −934 −500 −7108 | −2491 233 −8150 | −2567 43 −894 | −3083 −381 −1115 | −1203 399 −701 | −2300 106 −1378 | −2766 −626 * | −2540 210 * | −3082 −466 | −2237 −720 | −1672 275 | −1954 394 | −2240 45 | −2537 96 | 874 359 | −747 117 | −1844 −369 | −3333 −294 | −3093 −249 | 286 |
| 281(V) | −984 −149 −16 | −1045 −500 −7108 | −3169 233 −8150 | −2909 43 −894 | −1709 −381 −1115 | −2304 399 −701 | −2404 106 −1378 | 531 −626 * | −2643 210 * | −988 −466 | −697 −720 | −2378 275 | −2722 394 | −2480 45 | −2661 96 | −1601 359 | 1504 117 | 3014 −369 | −2588 −294 | −2201 −249 | 287 |
| 282(L) | −2631 −149 −16 | −2159 −500 −7108 | −4786 233 −8150 | −4228 43 −894 | −462 −381 −1115 | −4506 399 −701 | −3231 106 −1378 | 96 −626 * | −3878 210 * | 2828 −466 | 2482 −720 | −4157 275 | −3880 394 | −3016 45 | −3541 96 | −3793 359 | −2509 117 | −608 −369 | −2134 −294 | −2182 −249 | 288 |
| 283(H) | −3205 −149 −16 | −3079 −500 −7108 | −2723 233 −8150 | −2890 43 −894 | −2110 −381 −1115 | −3046 399 −701 | 5295 106 −1378 | −4135 −626 * | −2617 210 * | −3813 −466 | −3561 −720 | −2886 275 | −3482 394 | −2833 45 | −2620 96 | −3291 359 | −3356 117 | −3895 −369 | −2397 −294 | −1681 −249 | 289 |
| 284(L) | −1623 −149 −16 | −1338 −500 −7108 | −3726 233 −8150 | −3164 43 −894 | −251 −381 −1115 | −3255 399 −701 | −1820 106 −1378 | 1373 −626 * | −2808 210 * | 2371 −466 | 514 −720 | −2785 275 | −3086 394 | −2281 45 | −2613 96 | −2389 359 | −1543 117 | −161 −369 | −1311 −294 | 1782 −249 | 290 |
| 285(L) | −2333 −149 −16 | −1873 −500 −7108 | −4640 233 −8150 | −4127 43 −894 | −650 −381 −1115 | −4326 399 −701 | −3241 106 −1378 | 2176 −626 * | −3843 210 * | 2519 −466 | 523 −720 | −3982 275 | −3833 394 | −3105 45 | −3579 96 | −3604 359 | −2247 117 | 56 −369 | −2268 −294 | −2230 −249 | 291 |
| 286(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 292 |
| 287(M) | −1886 −149 −16 | −1507 −500 −7108 | −4178 233 −8150 | −3693 43 −894 | −877 −381 −1115 | −3806 399 −701 | −2901 106 −1378 | 3008 −626 * | −3380 210 * | 335 −466 | 3109 −720 | −3451 275 | −3570 394 | −2934 45 | −3251 96 | −3044 359 | −1840 117 | 524 −369 | −2288 −294 | −2089 −249 | 293 |

TABLE 7-continued

| | | | | | | | | | | | | | | | | |
|---|---|---|---|---|---|---|---|---|---|---|---|---|---|---|---|---|
| 288(A) | 3438 -149 -16 | -1472 -500 -7108 | -2846 233 -8150 | -3040 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 294 |
| — | | | | | | | | | | | | | | | | | | | | 295 |
| 289(H) | -1490 -149 -16 | -2484 -500 -7108 | -362 233 -8150 | -476 43 -894 | -1816 -381 -1115 | -1880 399 -701 | 4320 106 -1378 | -2854 -626 * | -684 210 * | -2770 -466 | -2133 -720 | 2185 275 | -2285 394 | -728 45 | -1000 96 | -1377 359 | -1550 117 | -2475 -369 | -2146 -294 | -1255 -249 | |
| — | | | | | | | | | | | | | | | | | | | | 296 |
| 290(A) | 2439 -149 -16 | -911 -500 -7108 | -2326 233 -8150 | -2131 43 -894 | -2811 -381 -1115 | -1197 399 -701 | -1934 106 -1378 | -2480 -626 * | -2011 210 * | -2745 -466 | -1898 -720 | -1490 275 | -1888 394 | -1785 45 | -2153 96 | 1898 359 | 1073 117 | -1682 -369 | -3044 -294 | -2749 -249 | |
| — | | | | | | | | | | | | | | | | | | | | 297 |
| 291(I) | 2038 -149 -16 | -985 -500 -7108 | -3388 233 -8150 | -2919 43 -894 | -1320 -381 -1115 | -2893 399 -701 | -2277 106 -1378 | 2155 -626 * | -2677 210 * | -587 -466 | -297 -720 | -2593 275 | -2992 394 | -2450 45 | -2697 96 | -2087 359 | -1208 117 | 1681 -369 | -2229 -294 | -1846 -249 | |
| — | | | | | | | | | | | | | | | | | | | | 298 |
| 292(G) | -1243 -149 -16 | -2769 -500 -7108 | 311 233 -8150 | 1902 43 -894 | -3172 -381 -1115 | 1980 399 -701 | -744 106 -1378 | -2992 -626 * | -697 210 * | -2936 -466 | -2152 -720 | 1923 275 | -1974 394 | -377 45 | -1331 96 | -1030 359 | -1284 117 | 2506 -369 | -3125 -294 | -2308 -249 | |
| — | | | | | | | | | | | | | | | | | | | | 299 |
| 293(V) | -1738 -149 -16 | -1298 -500 -7108 | -4281 233 -8150 | -3921 43 -894 | -1737 -381 -1115 | -3979 399 -701 | -3665 106 -1378 | 1917 -626 * | -3774 210 * | -601 -466 | -528 -720 | -3671 275 | -3834 394 | -3628 45 | -3843 96 | -3293 359 | -1735 117 | 3205 -369 | -3215 -294 | -2770 -249 | |
| — | | | | | | | | | | | | | | | | | | | | 300 |
| 294(E) | -833 -149 -16 | -2344 -500 -7108 | 1092 233 -8150 | 2412 43 -894 | -2643 -381 -1115 | -1464 399 -701 | -386 106 -1378 | -2413 -626 * | -146 210 * | -2369 -466 | -1505 -720 | -96 275 | 562 394 | 29 45 | -717 96 | -666 359 | 862 117 | -1966 -369 | -2562 -294 | -1818 -249 | |
| — | | | | | | | | | | | | | | | | | | | | 301 |
| 295(W) | -1380 -149 -16 | -1116 -500 -7108 | -3614 233 -8150 | -3026 43 -894 | 1322 -381 -1115 | -2981 399 -701 | -1582 106 -1378 | 1966 -626 * | -2661 210 * | 1775 -466 | 556 -720 | -2562 275 | -2865 394 | -2117 45 | -2424 96 | -2098 359 | -1302 117 | -187 -369 | 2908 -294 | -629 -249 | |
| — | | | | | | | | | | | | | | | | | | | | 302 |
| 296(T) | -350 -149 -16 | -973 -500 -7108 | -2204 233 -8150 | -2178 43 -894 | -2893 -381 -1115 | -1236 399 -701 | -2035 106 -1378 | -2561 -626 * | -2117 210 * | -2862 -466 | -2043 -720 | -1536 275 | -1946 394 | -1916 45 | -2214 96 | 1618 359 | 3198 117 | -1758 -369 | -3137 -294 | -2831 -249 | |
| — | | | | | | | | | | | | | | | | | | | | 303 |
| 297(L) | -1443 -149 -16 | -1269 -500 -7108 | -3144 233 -8150 | -2576 43 -894 | -528 -381 -1115 | -3014 399 -701 | -1816 106 -1378 | 1945 -626 * | -2155 210 * | 2102 -466 | 508 -720 | -2422 275 | -2899 394 | 1193 45 | -2133 96 | -2129 359 | -1369 117 | -50 -369 | -1616 -294 | -1384 -249 | |
| — | | | | | | | | | | | | | | | | | | | | 304 |
| 298(D) | -1826 -149 -16 | -3682 -500 -7108 | 3559 233 -8150 | 1199 43 -894 | -3883 -381 -1115 | 1662 399 -701 | -1073 106 -1378 | -3846 -626 * | -1391 210 * | -3720 -466 | -3110 -720 | -272 275 | -2222 394 | -760 45 | -2283 96 | -1471 359 | -1913 117 | -3321 -369 | -3864 -294 | -2864 -249 | |
| — | | | | | | | | | | | | | | | | | | | | 305 |
| 299(D) | -2784 -149 -16 | -3432 -500 -7108 | 4016 233 -8150 | -1200 43 -894 | 4140 -381 -1115 | -2466 399 -701 | -2197 106 -1378 | -4505 -626 * | -2621 210 * | -4365 -466 | -3956 -720 | -1551 275 | -3014 394 | -2039 45 | -3232 96 | -2593 359 | -2938 117 | -4046 -369 | -3710 -294 | -3552 -249 | |
| — | | | | | | | | | | | | | | | | | | | | 306 |
| 300(F) | -3342 -149 -16 | -2776 -500 -7108 | -4026 233 -8150 | -4232 43 -894 | 4354 -381 -1115 | -3545 399 -701 | -1431 106 -1378 | -2315 -626 * | -4038 210 * | -1801 -466 | -1900 -720 | -3299 275 | -3780 394 | -3350 45 | -3645 96 | -3490 359 | -3420 117 | -2566 -369 | -739 -294 | 349 -249 | |
| — | | | | | | | | | | | | | | | | | | | | 307 |
| 301(Q) | -1048 -149 -16 | -2608 -500 -7108 | 205 233 -8150 | 2170 43 -894 | -2893 -381 -1115 | -1535 399 -701 | -505 106 -1378 | -2680 -626 * | -255 210 * | -2604 -466 | -1769 -720 | 1814 275 | -1849 394 | 2272 45 | -789 96 | -848 359 | -1028 117 | -2228 -369 | -2770 -294 | -2013 -249 | |
| — | | | | | | | | | | | | | | | | | | | | 308 |
| 302(R) | 1083 -149 -16 | -1687 -500 -7108 | 691 233 -8150 | 135 43 -894 | -2058 -381 -1115 | -1406 399 -701 | -178 106 -1378 | -1755 -626 * | 214 210 * | -1793 -466 | -924 -720 | -145 275 | -1553 394 | 247 45 | 1670 96 | -383 359 | 1217 117 | -1367 -369 | -2031 -294 | -1404 -249 | |
| — | | | | | | | | | | | | | | | | | | | | 309 |
| 303(I) | -1915 -149 -16 | -1536 -500 -7108 | -4077 233 -8150 | -3667 43 -894 | 2027 -381 -1115 | -3678 399 -701 | -2155 106 -1378 | 3137 -626 * | -3381 210 * | 144 -466 | 94 -720 | -3225 275 | -3506 394 | -2848 45 | -3202 96 | -2914 359 | -1871 117 | 345 -369 | -1522 -294 | -791 -249 | |
| — | | | | | | | | | | | | | | | | | | | | 310 |
| 304(R) | -689 -149 -16 | -2015 -500 -7108 | -494 233 -8150 | 24 43 -894 | -2395 -381 -1115 | -1582 399 -701 | -184 106 -1378 | -2087 -626 * | 444 210 * | -2020 -466 | -1151 -720 | 1161 275 | -1687 394 | 1832 45 | 2131 96 | 626 359 | -614 117 | -1684 -369 | -2156 -294 | -1573 -249 | |

TABLE 7-continued

| | | | | | | | | | | | | | | | | | | |
|---|---|---|---|---|---|---|---|---|---|---|---|---|---|---|---|---|---|---|
| 305(D) | 387 -149 -16 | -1967 -500 -7108 | 1600 233 -8150 | 1359 43 -894 | -2275 -381 -1115 | -1391 399 -701 | 1561 106 -1378 | -2025 -626 * | 282 210 * | -1976 -466 | -1067 -720 | -25 275 | -1525 394 | 342 45 | 1024 96 | -369 359 | -443 117 | -1584 -369 | -2152 -294 | -1462 -249 | 311 |
| 306(R) | -1460 -149 -16 | -2315 -500 -7108 | -1793 233 -8150 | -887 43 -894 | -2832 -381 -1115 | -2237 399 -701 | -431 106 -1378 | -2288 -626 * | 2193 210 * | -2199 -466 | -1473 -720 | -946 275 | -2245 394 | -20 45 | 2706 96 | -1394 359 | -1275 117 | 591 -369 | -2248 -294 | -1961 -249 | 312 |
| 307(V) | -941 -149 -16 | -1027 -500 -7108 | -3099 233 -8150 | -2832 43 -894 | -1692 -381 -1115 | -2234 399 -701 | -2324 106 -1378 | 470 -626 * | -2565 210 * | -1003 -466 | -695 -720 | -2305 275 | -2663 394 | -2399 45 | -2587 96 | -1527 359 | 1858 117 | 2876 -369 | -2536 -294 | -2152 -249 | 313 |
| 308(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 314 |
| 309(V) | -1090 -149 -16 | -1215 -500 -7108 | -2097 233 -8150 | -1824 43 -894 | -819 -381 -1115 | -2221 399 -701 | 2699 106 -1378 | -287 -626 * | -1392 210 * | -1027 -466 | -591 -720 | -1674 275 | -2482 394 | -1446 45 | -1482 96 | -1482 359 | -1143 117 | 2879 -369 | -1420 -294 | -707 -249 | 315 |
| 310(L) | -2439 -149 -16 | -1972 -500 -7108 | -4702 233 -8150 | -4181 43 -894 | -588 -381 -1115 | -4401 399 -701 | -3258 106 -1378 | 1582 -626 * | -3881 210 * | 2757 -466 | 587 -720 | -4061 275 | -3862 394 | -3093 45 | -3590 96 | -3689 359 | -2344 117 | -130 -369 | -2230 -294 | -2217 -249 | 316 |
| 311(C) | 2157 -149 -16 | 4166 -500 -7108 | -3012 233 -8150 | -2973 43 -894 | -2780 -381 -1115 | 1022 399 -701 | -2337 106 -1378 | -2398 -626 * | -2724 210 * | -2744 -466 | -1930 -720 | -1786 275 | -1943 394 | -2372 45 | -2623 96 | -540 359 | -692 117 | -1624 -369 | -3091 -294 | -2881 -249 | 317 |
| 312(D) | -1732 -149 -16 | -3453 -500 -7108 | 3468 233 -8150 | 99 43 -894 | -3733 -381 -1115 | -1645 399 -701 | -1066 106 -1378 | -3747 -626 * | -1356 210 * | -3641 -466 | -3008 -720 | 1690 275 | -2201 394 | -755 45 | -2209 96 | -1416 359 | -1833 117 | -3208 -369 | -3752 -294 | -2776 -249 | 318 |
| 313(L) | -2477 -149 -16 | -2023 -500 -7108 | -4713 233 -8150 | -4122 43 -894 | 1592 -381 -1115 | -4329 399 -701 | -2920 106 -1378 | 72 -626 * | -3835 210 * | 2593 -466 | 2472 -720 | -3948 275 | -3754 394 | -2914 45 | -3466 96 | -3550 359 | -2350 117 | -634 -369 | -1927 -294 | -1830 -249 | 319 |
| 314(K) | -2620 -149 -16 | -2961 -500 -7108 | -2461 233 -8150 | -2046 43 -894 | -3743 -381 -1115 | -2791 399 -701 | -1570 106 -1378 | -3603 -626 * | 3784 210 * | -3387 -466 | -2839 -720 | -2048 275 | -3039 394 | -1260 45 | -465 96 | -2604 359 | -2536 117 | -3331 -369 | -3001 -294 | -2988 -249 | 320 |
| 315(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 321 |
| 316(S) | -897 -149 -16 | -1462 -500 -7108 | -2333 233 -8150 | -2543 43 -894 | -3185 -381 -1115 | -1640 399 -701 | -2474 106 -1378 | -3294 -626 * | -2686 210 * | -3497 -466 | -2780 -720 | -1973 275 | -2360 394 | -2483 45 | -2703 96 | 3465 359 | -1316 117 | -2413 -369 | -3310 -294 | -3025 -249 | 322 |
| 317(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 323 |
| 318(K) | 2 -149 -16 | -2257 -500 -7108 | -1073 233 -8150 | -374 43 -894 | -2740 -381 -1115 | -1908 399 -701 | -278 106 -1378 | -2339 -626 * | 2328 210 * | -2192 -466 | -1373 -720 | -562 275 | -1953 394 | 2273 45 | 1344 96 | -952 359 | -933 117 | -1980 -369 | -2234 -294 | -1799 -249 | 324 |
| 319(Y) | -3482 -149 -16 | -2868 -500 -7108 | -3701 233 -8150 | -3919 43 -894 | 238 -381 -1115 | -3552 399 -701 | 1112 106 -1378 | -3000 -626 * | -3638 210 * | -2516 -466 | -2526 -720 | -3027 275 | -3772 394 | -3101 45 | -3341 96 | -3418 359 | -3527 117 | -3071 -369 | 441 -294 | 4711 -249 | 325 |
| 320(M) | -1559 -149 -16 | -1267 -500 -7108 | -3829 233 -8150 | -3380 43 -894 | -1103 -381 -1115 | -3357 399 -701 | -2655 106 -1378 | 805 -626 * | -3067 210 * | -64 -466 | 3046 -720 | -3065 275 | -3326 394 | -2779 45 | -3011 96 | -2591 359 | -1556 117 | 2855 -369 | -2312 -294 | -1998 -249 | 326 |
| 321(M) | 1225 -149 -16 | -469 -500 -7108 | -2256 233 -8150 | -1679 43 -894 | 1656 -381 -1115 | -1926 399 -701 | -870 106 -1378 | 90 -626 * | -1396 210 * | -210 -466 | 2763 -720 | -1424 275 | -2028 394 | -1129 45 | -1411 96 | -1008 359 | 712 117 | 154 -369 | -951 -294 | -586 -249 | 327 |

TABLE 7-continued

| | | | | | | | | | | | | | | | | | | |
|---|---|---|---|---|---|---|---|---|---|---|---|---|---|---|---|---|---|---|
| 322(T) | −738 −149 −16 | −2094 −500 −7108 | −84 233 −8150 | 1704 43 −894 | −2416 −381 −1115 | −1495 399 −701 | −317 106 −1378 | −2135 −626 * | 61 210 * | −2127 −466 | −1275 −720 | −163 275 | −1704 394 | 1857 45 | −405 96 | −613 359 | 1930 117 | −1734 −369 | −2331 −294 | −1668 −249 | 328 |
| 323(D) | −1746 −149 −16 | −3458 −500 −7108 | 3540 233 −8150 | 90 43 −894 | −3744 −381 −1115 | −1650 399 −701 | −1081 106 −1378 | −3767 −626 * | −1381 210 * | −3662 −466 | −3036 −720 | 1386 275 | −2211 394 | −772 45 | −2239 96 | −1429 359 | −1850 117 | −3226 −369 | −3765 −294 | −2789 −249 | 329 |
| 324(L) | −2451 −149 −16 | −1983 −500 −7108 | −4707 233 −8150 | −4186 43 −894 | −582 −381 −1115 | −4409 399 −701 | −3259 106 −1378 | 1510 −626 * | −3884 210 * | 2778 −466 | 592 −720 | −4069 275 | −3865 394 | −3091 45 | −3590 96 | −3698 359 | −2355 117 | −150 −369 | −2226 −294 | −2214 −249 | 330 |
| 325(H) | −2923 −149 −16 | −2573 −500 −7108 | −2959 233 −8150 | −2926 43 −894 | 826 −381 −1115 | −3449 399 −701 | 4553 106 −1378 | −2508 −626 * | −2463 210 * | −2054 −466 | −1948 −720 | −2279 275 | −3499 394 | −2191 45 | −2397 96 | −2761 359 | −2855 117 | −2540 −369 | 123 −294 | 2920 −249 | 331 |
| 326(K) | 373 −149 −16 | −1957 −500 −7108 | −342 233 −8150 | 1025 43 −894 | −2297 −381 −1115 | −1472 399 −701 | −98 106 −1378 | −2018 −626 * | 2111 210 * | −1954 −466 | −1056 −720 | 906 275 | −1570 394 | 352 45 | 685 96 | −424 359 | −473 117 | −1592 −369 | −2105 −294 | −1469 −249 | 332 |
| 327(V) | 1739 −149 −16 | −1008 −500 −7108 | −3509 233 −8150 | −3043 43 −894 | −1376 −381 −1115 | −3028 399 −701 | −2406 106 −1378 | 1765 −626 * | −2807 210 * | −615 −466 | −334 −720 | −2718 275 | −3093 394 | −2585 45 | −2823 96 | −2226 359 | −1263 117 | 2376 −369 | −2322 −294 | −1931 −249 | 333 |
| 328(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 334 |
| 329(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 335 |
| 330(I) | −1758 −149 −16 | −1302 −500 −7108 | −4331 233 −8150 | −3970 43 −894 | −1756 −381 −1115 | −4054 399 −701 | −3748 106 −1378 | 2976 −626 * | −3840 210 * | −603 −466 | −533 −720 | −3731 275 | −3877 394 | −3693 45 | −3914 96 | −3372 359 | −1750 117 | 2505 −369 | −3265 −294 | −2824 −249 | 336 |
| 331(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 337 |
| 332(Q) | 1795 −149 −16 | −1440 −500 −7108 | −730 233 −8150 | 492 43 −894 | −2453 −381 −1115 | 682 399 −701 | −812 106 −1378 | −2151 −626 * | −508 210 * | −2256 −466 | −1426 −720 | −624 275 | −1796 394 | 2666 45 | −901 96 | −590 359 | −689 117 | −1636 −369 | −2510 −294 | −1971 −249 | 338 |
| 333(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 339 |
| 334(M) | −2355 −149 −16 | −1988 −500 −7108 | −4343 233 −8150 | −3834 43 −894 | −504 −381 −1115 | −4051 399 −701 | −2868 106 −1378 | 105 −626 * | −3385 210 * | 1451 −466 | 4460 −720 | −3680 275 | −3671 394 | −2806 45 | −3171 96 | −3327 359 | −2274 117 | −474 −369 | −2039 −294 | −1925 −249 | 340 |
| 335(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 341 |
| 336(Y) | −1187 −149 −16 | −974 −500 −7108 | −3186 233 −8150 | −2638 43 −894 | −117 −381 −1115 | −2732 399 −701 | −1255 106 −1378 | 1905 −626 * | −2270 210 * | 73 −466 | 1977 −720 | −2217 275 | −2699 394 | −1882 45 | −2144 96 | −1841 359 | −1124 117 | 71 −369 | −907 −294 | 3254 −249 | 342 |
| 337(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 343 |
| 338(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 344 |

TABLE 7-continued

| | | | | | | | | | | | | | | | | | | | |
|---|---|---|---|---|---|---|---|---|---|---|---|---|---|---|---|---|---|---|---|
| 339(K) | -864 -149 -16 | -1785 -500 -7108 | -860 233 -8150 | -366 43 -894 | -2128 -381 -1115 | -1763 399 -701 | -407 106 -1378 | -1612 -626 * | 2624 210 | -1800 -466 | -1045 -720 | 629 275 | -1900 394 | -28 45 | 62 96 | -851 359 | -805 117 | 1127 -369 | -2064 -294 | -1581 -249 | 345 |
| — — | | | | | | | | | | | | | | | | | | | | |
| 340(N) | 602 -149 -16 | -1686 -500 -7108 | -275 233 -8150 | 1008 43 -894 | -1926 -381 -1115 | -1415 399 -701 | 1528 106 -1378 | -1618 -626 * | 244 210 | -1673 -466 | -815 -720 | 1897 275 | -1530 394 | 299 45 | -244 96 | -371 359 | -391 117 | 322 -369 | -1934 -294 | -1306 -249 | 346 |
| 341(G) | -1709 -149 -16 | -2639 -500 -7108 | 1362 233 -8150 | -690 43 -894 | -3785 -381 -1115 | 3257 399 -701 | -1671 106 -1378 | -3805 -626 * | -1946 210 | -3792 -466 | -3137 -720 | -980 275 | -2480 394 | -1424 45 | -2576 96 | -1630 359 | -1936 117 | -3150 -369 | -3628 -294 | -3155 -249 | 347 |
| 342(F) | -942 -149 -16 | -799 -500 -7108 | -2828 233 -8150 | -2226 43 -894 | 1797 -381 -1115 | -2476 399 -701 | -1269 106 -1378 | 1109 -626 * | 581 210 | 1793 -466 | 516 -720 | -1952 275 | -2453 394 | -1557 45 | -1815 96 | -1558 359 | -875 117 | 52 -369 | -1138 -294 | -794 -249 | 348 |
| 343(L) | -2451 -149 -16 | -1983 -500 -7108 | -4707 233 -8150 | -4186 43 -894 | -582 -381 -1115 | -4409 399 -701 | -3259 106 -1378 | 1510 -626 * | -3884 210 | 2778 -466 | 592 -720 | -4069 275 | -3865 394 | -3091 45 | -3590 96 | -3698 359 | -2355 117 | -150 -369 | -2226 -294 | -2214 -249 | 349 |
| 344(H) | -3205 -149 -16 | -3079 -500 -7108 | -2723 233 -8150 | -2890 43 -894 | -2110 -381 -1115 | -3046 399 -701 | 5295 106 -1378 | -4135 -626 * | -2617 210 | -3813 -466 | -3561 -720 | -2886 275 | -3482 394 | -2833 45 | -2620 96 | -3291 359 | -3356 117 | -3895 -369 | -2397 -294 | -1681 -249 | 350 |
| 345(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 | -4671 -466 | -4212 -720 | -3320 275 | -3352 394 | -3748 45 | -3779 96 | -2839 359 | -2981 117 | -4004 -369 | -3668 -294 | -4222 -249 | 351 |
| 346(D) | -2784 -149 -16 | -3432 -500 -7108 | 4016 233 -8150 | -1200 43 -894 | -4140 -381 -1115 | -2466 399 -701 | -2197 106 -1378 | -4505 -626 * | -2621 210 | -4365 -466 | -3956 -720 | -1551 275 | -3014 394 | -2039 45 | -3232 96 | -2593 359 | -2938 117 | -4046 -369 | -3710 -294 | -3552 -249 | 352 |
| 347(C) | 774 -149 -16 | 4452 -500 -7108 | -2162 233 -8150 | -1688 43 -894 | -1962 -381 -1115 | -1478 399 -701 | -1302 106 -1378 | -1474 -626 * | -944 210 | -1796 -466 | -1088 -720 | -1351 275 | -1979 394 | -1147 45 | 1684 96 | -732 359 | -719 117 | -1116 -369 | -2225 -294 | -1881 -249 | 353 |
| 348(L) | -2387 -149 -16 | -1922 -500 -7108 | -4674 233 -8150 | -4155 43 -894 | -617 -381 -1115 | -4366 399 -701 | -3250 106 -1378 | 1889 -626 * | -3865 210 | 2650 -466 | 558 -720 | -4023 275 | -3847 394 | -3098 45 | -3586 96 | -3647 359 | -2296 117 | -38 -369 | -2247 -294 | -2224 -249 | 354 |
| 349(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 | -3105 -466 | -2612 -720 | -2311 275 | -2600 394 | -2708 45 | -2753 96 | -1463 359 | 3819 117 | -2197 -369 | -3286 -294 | -3156 -249 | 355 |
| 350(C) | -1489 -149 -16 | 2972 -500 -7108 | -4007 233 -8150 | -3563 43 -894 | -1524 -381 -1115 | -3541 399 -701 | -2939 106 -1378 | 2612 -626 * | -3350 210 | -617 -466 | -413 -720 | -3224 275 | -3470 394 | -3129 45 | -3335 96 | -2770 359 | -1475 117 | 2269 -369 | -2657 -294 | -2248 -249 | 356 |
| 351(T) | -364 -149 -16 | -979 -500 -7108 | -2232 233 -8150 | -2250 43 -894 | -2904 -381 -1115 | -1245 399 -701 | -2090 106 -1378 | -2559 -626 * | -2191 210 | -2881 -466 | -2075 -720 | -1571 275 | -1964 394 | -1991 45 | -2260 96 | 905 359 | 3428 117 | -1762 -369 | -3159 -294 | -2858 -249 | 357 |
| 352(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 | -4671 -466 | -4212 -720 | -3320 275 | -3352 394 | -3748 45 | -3779 96 | -2839 359 | -2981 117 | -4004 -369 | -3668 -294 | -4222 -249 | 358 |
| 353(K) | -1716 -149 -16 | -2632 -500 -7108 | -2004 233 -8150 | -1008 43 -894 | -3336 -381 -1115 | -2379 399 -701 | -444 106 -1378 | -2764 -626 * | 2775 210 | -2484 -466 | -1756 -720 | -1035 275 | -2357 394 | 2151 45 | 1811 96 | -1592 359 | -1477 117 | -2481 -369 | -2391 -294 | -2172 -249 | 359 |
| 354(T) | -1213 -149 -16 | -1674 -500 -7108 | -2755 233 -8150 | -2906 43 -894 | -3163 -381 -1115 | -1922 399 -701 | -2659 106 -1378 | -2698 -626 * | -2788 210 | -3105 -466 | -2612 -720 | -2311 275 | -2600 394 | -2708 45 | -2753 96 | -1463 359 | 3819 117 | -2197 -369 | -3286 -294 | -3156 -249 | 360 |
| 355(V) | -1771 -149 -16 | -1339 -500 -7108 | -4275 233 -8150 | -3816 43 -894 | -1235 -381 -1115 | -3919 399 -701 | -3194 106 -1378 | 2139 -626 * | -3617 210 | 1520 -466 | -66 -720 | -3558 275 | -3681 394 | -3244 45 | -3547 96 | -3164 359 | -1733 117 | 2390 -369 | -2634 -294 | -2369 -249 | 361 |

TABLE 7-continued

| | | | | | | | | | | | | | | | | | | | | |
|---|---|---|---|---|---|---|---|---|---|---|---|---|---|---|---|---|---|---|---|---|
| 356(A) | 3438 | −1472 | −2846 | −3040 | −3287 | −1726 | −2735 | −2840 | −3028 | −3257 | −2662 | −2236 | −2447 | −2798 | −2944 | −1216 | −1387 | −2183 | −3405 | −3320 | 362 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 357(E) | −2641 | −3308 | −896 | 3732 | −3966 | −2458 | −2043 | −4105 | −2128 | −4016 | −3555 | −1531 | −2959 | −1842 | −2560 | −2479 | −2750 | −3722 | −3563 | −3385 | 363 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 358(N) | −823 | −1917 | −96 | 1188 | −2187 | −1547 | −506 | −1711 | −265 | −1955 | −1191 | 2711 | −1815 | −144 | −747 | −757 | −815 | 1140 | −2297 | −1666 | 364 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 359(L) | −2153 | −1779 | −4360 | −3884 | −675 | −3965 | −3012 | 392 | −3561 | 2726 | 467 | −3673 | −3662 | −2955 | −3355 | −3239 | −2102 | 1281 | −2207 | −2099 | 365 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 360(E) | 1136 | −2084 | −175 | 2027 | −2436 | −1510 | −274 | −2147 | −1525 | −2118 | −1254 | −175 | −1692 | 152 | −251 | −593 | −670 | −1736 | −2296 | −1650 | 366 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 361(H) | 893 | −1761 | 1357 | 214 | −2092 | −1387 | 1862 | −1810 | 229 | −1825 | −942 | −83 | −1527 | 293 | −273 | 640 | 793 | −1409 | −2050 | −1397 | 367 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 362(I) | 608 | −458 | −2776 | −2176 | 1666 | −2202 | −1113 | 1712 | −1836 | −222 | 338 | −1782 | −2245 | −1512 | −1731 | −1292 | 867 | 1366 | −1036 | −684 | 368 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 363(P) | −922 | −1912 | 1681 | −141 | −2123 | −1604 | −687 | −1787 | −550 | 187 | −1245 | −427 | 2677 | −363 | −1049 | −882 | −947 | −1524 | −2338 | −1711 | 369 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 364(D) | −1692 | −3605 | 3364 | 1256 | −3770 | −1599 | −957 | −3700 | −1216 | −3569 | −2909 | 1025 | −2138 | −628 | −2083 | −1346 | −1761 | −3174 | −3765 | −2738 | 370 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 365(Q) | −877 | −1646 | −633 | 499 | −1610 | −1781 | −505 | −1210 | −63 | 1648 | −649 | −558 | −1931 | 2241 | −360 | −907 | −814 | −1097 | −1882 | −1385 | 371 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 366(P) | −648 | −2019 | 1139 | 203 | −2354 | −1436 | −285 | −2089 | 29 | −2086 | −1217 | −114 | 1965 | 1445 | −492 | −529 | 1244 | −1672 | −2300 | −1616 | 372 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 367(R) | −422 | −1009 | −851 | −304 | 1406 | −1496 | −183 | −740 | 147 | −894 | −230 | −440 | 775 | 21 | 2009 | −539 | −381 | −568 | −1136 | −521 | 373 |
| — | −149 | −500 | 233 | 43 | −381 | 399 | 2249 | −626 | 210 | −466 | −720 | 275 | 394 | 45 | 96 | 359 | 117 | −369 | −294 | −249 |
| — | −23 | −6560 | −7602 | −894 | −1115 | −341 | −1378 | * | * | | | | | | | | | | | |
| 368(D) | 1472 | −1668 | 1835 | −70 | −2356 | −1385 | −511 | −2062 | −246 | −2128 | −1275 | −318 | 1353 | −118 | −746 | −526 | 425 | −1602 | −2380 | −1752 | 374 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 369(G) | −1044 | −2230 | 2141 | −100 | −3222 | 2291 | −982 | −3045 | −1033 | −3050 | −2258 | −395 | −1985 | −644 | −1669 | 858 | −1207 | −2428 | −3250 | −2493 | 375 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 370(Q) | −2562 | −2904 | −1886 | −1971 | −3251 | −2661 | −2079 | −3690 | −1565 | −3469 | −3081 | −2107 | −3091 | 4371 | −1665 | −2585 | −2674 | −3411 | −3077 | −2821 | 376 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 371(D) | −1275 | −2955 | 2862 | 1330 | −3205 | −1556 | −670 | −3029 | 1509 | −2936 | −2141 | −158 | −1955 | −290 | −1213 | −1025 | −1281 | −2554 | −3111 | −2272 | 377 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |
| 372(V) | −1738 | −1298 | −4281 | −3921 | −1737 | −3979 | −3665 | 1917 | −3774 | −601 | −528 | −3671 | −3834 | −3628 | −3843 | −3293 | −1735 | 3205 | −3215 | −2770 | 378 |
| — | −149 | −500 | 233 | 43 | −381 | 399 | 106 | −626 | 210 | −466 | −720 | 275 | 394 | 45 | 96 | 359 | 117 | −369 | −294 | −249 |
| — | −16 | −7108 | −8150 | −894 | −1115 | −701 | −1378 | * | * | | | | | | | | | | | |

TABLE 7-continued

| | | | | | | | | | | | | | | | | | |
|---|---|---|---|---|---|---|---|---|---|---|---|---|---|---|---|---|---|
| 373(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 379 |
| 374(M) | −584 −149 −16 | −1354 −500 −7108 | −847 233 −8150 | −246 43 −894 | −1467 −381 −1115 | −1659 399 −701 | 2505 106 −1378 | −1087 −626 * | 212 210 * | −374 −466 | 2571 −720 | −449 275 | −1729 394 | 1171 45 | 1074 96 | −634 359 | −507 117 | −876 −369 | −1617 −294 | −1128 −249 | 380 |
| 375(P) | −910 −149 −16 | −2031 −500 −7108 | −73 233 −8150 | 1195 43 −894 | −2792 −381 −1115 | −1488 399 −701 | −794 106 −1378 | −2539 −626 * | −629 210 * | −2588 −466 | −1788 −720 | −401 275 | 3005 394 | −439 45 | −1131 96 | 612 359 | −1014 117 | −2050 −369 | −2815 −294 | −2151 −249 | 381 |
| 376(W) | −1588 −149 −16 | −1300 −500 −7108 | −3783 233 −8150 | −3197 43 −894 | −329 −381 −1115 | −3245 399 −701 | −1926 106 −1378 | 2071 −626 * | −2827 210 * | 1901 −466 | 558 −720 | −2822 275 | −3072 394 | −2297 45 | −2616 96 | −2381 359 | −1508 117 | −111 −369 | 3483 −294 | −1042 −249 | 382 |
| 377(E) | −1024 −149 −16 | −2640 −500 −7108 | 1844 233 −8150 | 2310 43 −894 | −2908 −381 −1115 | −1498 399 −701 | −505 106 −1378 | −2711 −626 * | −344 210 * | −2636 −466 | −1791 −720 | −107 275 | −1824 394 | 1521 45 | −957 96 | 207 359 | −1011 117 | −2243 −369 | −2817 −294 | −2021 −249 | 383 |
| 378(N) | −826 −149 −16 | −2349 −500 −7108 | 1089 233 −8150 | 227 43 −894 | −2651 −381 −1115 | −1487 399 −701 | −341 106 −1378 | −2416 −626 * | 1494 210 * | −2346 −466 | −1475 −720 | 2601 275 | −1724 394 | 1005 45 | −522 96 | −657 359 | −787 117 | −1968 −369 | −2511 −294 | −1791 −249 | 384 |
| 379(P) | 1932 −149 −16 | −1116 −500 −7108 | −2232 233 −8150 | −2301 43 −894 | −3058 −381 −1115 | −1358 399 −701 | −2206 106 −1378 | −2706 −626 * | −2336 210 * | −3009 −466 | −2238 −720 | −1674 275 | 3274 394 | −2114 45 | −2406 96 | −739 359 | −914 117 | −1913 −369 | −3260 −294 | −3019 −249 | 385 |
| 380(V) | −914 −149 −16 | −773 −500 −7108 | −2713 233 −8150 | −2129 43 −894 | −712 −381 −1115 | −2505 399 −701 | −1388 106 −1378 | 1452 −626 * | 1084 210 * | 1324 −466 | 204 −720 | −1926 275 | −2507 394 | −1580 45 | −1808 96 | −1591 359 | −859 117 | 1713 −369 | −1424 −294 | −1081 −249 | 386 |
| 381(Y) | −1484 −149 −16 | −2331 −500 −7108 | −1762 233 −8150 | −887 43 −894 | −2436 −381 −1115 | −2254 399 −701 | −420 106 −1378 | −2325 −626 * | 2137 210 * | −2195 −466 | −1475 −720 | −949 275 | −2258 394 | −39 45 | 1983 96 | −1411 359 | −1295 117 | −2075 −369 | −2087 −294 | 2868 −249 | 387 |
| 382(E) | 1256 −149 −16 | −1890 −500 −7108 | −206 233 −8150 | 1353 43 −894 | −2196 −381 −1115 | −1401 399 −701 | −89 106 −1378 | −1930 −626 * | 812 210 * | −1898 −466 | −996 −720 | −45 275 | 547 394 | 1252 45 | −162 96 | −356 359 | −414 117 | −1507 −369 | −2083 −294 | −1416 −249 | 388 |
| 383(Q) | −752 −149 −16 | −2272 −500 −7108 | 1586 233 −8150 | 1407 43 −894 | −2561 −381 −1115 | −1448 399 −701 | −308 106 −1378 | −2329 −626 * | −23 210 * | −2276 −466 | −1396 −720 | −71 275 | −1677 394 | 1749 45 | −577 96 | −590 359 | 1569 117 | −1881 −369 | −2459 −294 | −1727 −249 | 389 |
| 384(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 390 |
| 385(H) | −964 −149 −16 | −2089 −500 −7108 | −200 233 −8150 | −136 43 −894 | −2264 −381 −1115 | −1600 399 −701 | 3833 106 −1378 | −2320 −626 * | −296 210 * | −2338 −466 | −1558 −720 | 1362 275 | 1479 394 | −276 45 | −699 96 | −881 359 | −992 117 | −1924 −369 | −2364 −294 | −1652 −249 | 391 |
| 386(L) | −2451 −149 −16 | −1983 −500 −7108 | −4707 233 −8150 | −4186 43 −894 | −582 −381 −1115 | −4409 399 −701 | −3259 106 −1378 | 1510 −626 * | −3884 210 * | 2778 −466 | 592 −720 | −4069 275 | −3865 394 | −3091 45 | −3590 96 | −3698 359 | −2355 117 | −150 −369 | −2226 −294 | −2214 −249 | 392 |
| 387(Q) | 1643 −149 −16 | −1017 −500 −7108 | −1196 233 −8150 | −721 43 −894 | −1189 −381 −1115 | −1714 399 −701 | −668 106 −1378 | 1336 −626 * | −497 210 * | −907 −466 | −297 −720 | −823 275 | −1893 394 | 2044 45 | −794 96 | −784 359 | −569 117 | −339 −369 | −1579 −294 | −1135 −249 | 393 |
| 388(I) | −1760 −149 −16 | −1308 −500 −7108 | −4323 233 −8150 | −3961 43 −894 | −1730 −381 −1115 | −4039 399 −701 | −3721 106 −1378 | 3156 −626 * | −3825 210 * | −575 −466 | −512 −720 | −3720 275 | −3867 394 | −3669 45 | −3893 96 | −3356 359 | −1753 117 | 2241 −369 | −3236 −294 | −2802 −249 | 394 |
| 389(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 395 |

TABLE 7-continued

| | | | | | | | | | | | | | | | | | | | | |
|---|---|---|---|---|---|---|---|---|---|---|---|---|---|---|---|---|---|---|---|---|
| 390(K) | −1259 −149 −16 | −2115 −500 −7108 | −1267 233 −8150 | −676 43 −894 | −970 −381 −1115 | −2105 399 −701 | 1794 106 −1378 | −2040 −626 * | 2549 210 * | −1955 −466 | −1282 −720 | −808 275 | −2165 394 | −167 45 | 114 96 | −1192 359 | −1140 117 | −1801 −369 | −1301 −294 | 2517 −249 | 396 |
| 391(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 397 |
| 392(N) | −2171 −149 −16 | −2655 −500 −7108 | −1458 233 −8150 | −1748 43 −894 | −3334 −381 −1115 | −2364 399 −701 | −2267 106 −1378 | −3943 −626 * | −2365 210 * | −3936 −466 | −3437 −720 | 4205 275 | −2932 394 | −2205 45 | −2608 96 | −2224 359 | −2439 117 | −3392 −369 | −3253 −294 | −2909 −249 | 398 |
| 393(L) | −2871 −149 −16 | −2457 −500 −7108 | −4231 233 −8150 | −4103 43 −894 | −1033 −381 −1115 | −3803 399 −701 | −3165 106 −1378 | −541 −626 * | −3734 210 * | 3130 −466 | −31 −720 | −3935 275 | −3797 394 | −3286 45 | −3484 96 | −3713 359 | −2869 117 | −1136 −369 | −2394 −294 | −2220 −249 | 399 |
| 394(A) | 3121 −149 −16 | −934 −500 −7108 | −2489 233 −8150 | −2561 43 −894 | −3081 −381 −1115 | −1203 399 −701 | −2295 106 −1378 | −2766 −626 * | −2533 210 * | −3080 −466 | −2234 −720 | −1669 275 | −1953 394 | −2234 45 | −2533 96 | 936 359 | −746 117 | −1844 −369 | −3331 −294 | −3090 −249 | 400 |
| 395(E) | −522 −149 −16 | −1773 −500 −7108 | −240 233 −8150 | 1676 43 −894 | −2248 −381 −1115 | −1396 399 −701 | −289 106 −1378 | −1968 −626 * | 50 210 * | −1989 −466 | −1115 −720 | −174 275 | 1198 394 | 131 45 | −448 96 | 1226 359 | 677 117 | −1538 −369 | −2214 −294 | −1565 −249 | 401 |
| 396(E) | −1481 −149 −16 | −3230 −500 −7108 | 1425 233 −8150 | 2936 43 −894 | −3481 −381 −1115 | 751 399 −701 | −843 106 −1378 | −3354 −626 * | −954 210 * | −3256 −466 | −2520 −720 | −187 275 | −2057 394 | −492 45 | −1711 96 | −1193 359 | −1527 117 | −2852 −369 | −3445 −294 | −2523 −249 | 402 |
| 397(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 403 |
| 398(A) | 2847 −149 −16 | −932 −500 −7108 | −2454 233 −8150 | −2477 43 −894 | −3066 −381 −1115 | −1198 399 −701 | −2236 106 −1378 | −2763 −626 * | −2439 210 * | −3057 −466 | −2202 −720 | −1635 275 | −1940 394 | −2152 45 | −2471 96 | 1777 359 | −731 117 | −1840 −369 | −3306 −294 | −3056 −249 | 404 |
| 399(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 405 |
| 400(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 406 |
| 401(K) | −2620 −149 −16 | −2961 −500 −7108 | −2461 233 −8150 | −2046 43 −894 | −3743 −381 −1115 | −2791 399 −701 | −1570 106 −1378 | −3603 −626 * | 3784 210 * | −3387 −466 | −2839 −720 | −2048 275 | −3039 394 | −1260 45 | −465 96 | −2604 359 | −2536 117 | −3331 −369 | −3001 −294 | −2988 −249 | 407 |
| 402(I) | −1761 −149 −16 | −1312 −500 −7108 | 4317 233 −8150 | −3954 43 −894 | −1713 −381 −1115 | −4027 399 −701 | −3703 106 −1378 | 3225 −626 * | −3814 210 * | −556 −466 | −498 −720 | −3712 275 | −3859 394 | −3653 45 | −3877 96 | −3344 359 | −1754 117 | 2110 −369 | −3216 −294 | −2787 −249 | 408 |
| 403(S) | −348 −149 −16 | −981 −500 −7108 | −2200 233 −8150 | −2194 43 −894 | −2989 −381 −1115 | −1227 399 −701 | −2073 106 −1378 | −2686 −626 * | −2157 210 * | −2970 −466 | −2136 −720 | −1541 275 | −1946 394 | −1946 45 | −2253 96 | 3060 359 | 1398 117 | −1824 −369 | −3217 −294 | −2916 −249 | 409 |
| 404(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 410 |
| 405(V) | −917 −149 −16 | −809 −500 −7108 | −2556 233 −8150 | −1976 43 −894 | −827 −381 −1115 | −2491 399 −701 | −1367 106 −1378 | 1339 −626 * | 1455 210 * | 721 −466 | 94 −720 | −1841 275 | −2501 394 | −1487 45 | −1710 96 | −1570 359 | −863 117 | 2038 −369 | −1514 −294 | −1151 −249 | 411 |
| 406(K) | −1386 −149 −16 | −2643 −500 −7108 | −447 233 −8150 | 1824 43 −894 | −3108 −381 −1115 | −1893 399 −701 | −570 106 −1378 | −2762 −626 * | 2860 210 * | −2616 −466 | −1848 −720 | −552 275 | −2117 394 | −166 45 | −3 96 | −1217 359 | −1300 117 | −2388 −369 | −2647 −294 | −2154 −249 | 412 |

| | | | | | | | | | | | | | | | | | |
|---|---|---|---|---|---|---|---|---|---|---|---|---|---|---|---|---|---|
| 407(N) | -537 -149 -16 | -1563 -500 -7108 | -449 233 -8150 | -36 -894 | -1889 -381 -1115 | 1143 399 -701 | -307 106 -1378 | -1529 -626 * | 932 210 * | -1655 -466 | -844 -720 | 1794 275 | -1658 394 | 73 45 | -356 96 | -518 359 | -516 117 | 924 -369 | -1962 -294 | -1392 -249 | 413 |
| 408(P) | -894 -149 -16 | -2181 -500 -7108 | -369 233 -8150 | 1705 43 -894 | -2576 -381 -1115 | -1650 399 -701 | -357 106 -1378 | -2268 -626 * | 243 210 * | -2210 -466 | -1375 -720 | -330 275 | 2093 394 | 63 45 | 1619 96 | -774 359 | -835 117 | -1876 -369 | -2347 -294 | -1769 -249 | 414 |
| 409(V) | -419 -149 -16 | -634 -500 -7108 | -1376 233 -8150 | -807 43 -894 | 1053 -381 -1115 | -1737 399 -701 | -499 106 -1378 | -198 -626 * | -623 210 * | -505 -466 | 178 -720 | 600 275 | -1807 394 | -475 45 | 475 96 | 313 359 | -360 117 | 1389 -369 | -1016 -294 | 1303 -249 | 415 |
| 410(I) | -1282 -149 -16 | -1082 -500 -7108 | -3022 233 -8150 | -2555 43 -894 | 2426 -381 -1115 | -2683 399 -701 | 1767 106 -1378 | 2555 -626 * | -2191 210 * | -443 -466 | -88 -720 | -2038 275 | -2692 394 | -1794 45 | -2075 96 | -1793 359 | -1220 117 | -317 -369 | -361 -294 | 552 -249 | 416 |
| 411(T) | -499 -149 -16 | -1595 -500 -7108 | -431 233 -8150 | 966 43 -894 | -1830 -381 -1115 | -1487 399 -701 | -185 106 -1378 | -1449 -626 * | 1092 210 * | -1574 -466 | -754 -720 | -207 275 | -1601 394 | 213 45 | -206 96 | -458 359 | 2067 117 | 159 -369 | -1877 -294 | -1296 -249 | 417 |
| 412(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 418 |
| 413(P) | -632 -149 -16 | -1230 -500 -7108 | -2074 233 -8150 | -2144 43 -894 | -2996 -381 -1115 | -1453 399 -701 | -2116 106 -1378 | -2631 -626 * | -2128 210 * | -2928 -466 | -2213 -720 | -1658 275 | 3610 394 | -2006 45 | -2221 96 | -852 359 | 1302 117 | -1931 -369 | -3185 -294 | -2917 -249 | 419 |
| 414(A) | 3438 -149 -16 | -1472 -500 -7108 | -2846 233 -8150 | -3040 43 -894 | -3287 -381 -1115 | -1726 399 -701 | -2735 106 -1378 | -2840 -626 * | -3028 210 * | -3257 -466 | -2662 -720 | -2236 275 | -2447 394 | -2798 45 | -2944 96 | -1216 359 | -1387 117 | -2183 -369 | -3405 -294 | -3320 -249 | 420 |
| 415(R) | -1454 -149 -16 | -2316 -500 -7108 | -1780 233 -8150 | -878 43 -894 | -2834 -381 -1115 | -2232 399 -701 | -428 106 -1378 | -2292 -626 * | 2281 210 * | -2200 -466 | -1473 -720 | -940 275 | -2240 394 | -17 45 | 2627 96 | -1386 359 | -1270 117 | 588 -369 | -2249 -294 | -1960 -249 | 421 |
| 416(V) | -1771 -149 -16 | -1603 -500 -7108 | -3750 233 -8150 | -3689 43 -894 | -2037 -381 -1115 | -3050 399 -701 | -3231 106 -1378 | 403 -626 * | -3479 210 * | -1154 -466 | -1076 -720 | -3246 275 | -3399 394 | -3383 45 | -3437 96 | -2628 359 | -1917 117 | 3536 -369 | -3074 -294 | -2677 -249 | 422 |
| 417(F) | -3342 -149 -16 | -2776 -500 -7108 | -4026 233 -8150 | -4232 43 -894 | 4354 -381 -1115 | -3545 399 -701 | -1431 106 -1378 | -2315 -626 * | -4038 210 * | -1801 -466 | -1900 -720 | -3299 275 | -3780 394 | -3350 45 | -3645 96 | -3490 359 | -3420 117 | -2566 -369 | -739 -294 | 349 -249 | 423 |
| 418(D) | -1572 -149 -16 | -3426 -500 -7108 | 2573 233 -8150 | 2447 43 -894 | -3613 -381 -1115 | -1583 399 -701 | -879 106 -1378 | -3513 -626 * | -1050 210 * | -3393 -466 | -2684 -720 | 1292 275 | -2085 394 | -535 45 | -1855 96 | -1253 359 | -1623 117 | -3000 -369 | -3585 -294 | -2609 -249 | 424 |
| 419(S) | -879 -149 -16 | -1989 -500 -7108 | 1498 233 -8150 | -177 43 -894 | -3045 -381 -1115 | 1600 399 -701 | -939 106 -1378 | -2843 -626 * | -904 210 * | -2867 -466 | -2046 -720 | -438 275 | -1922 394 | -591 45 | -1483 96 | 2171 359 | -1044 117 | -2226 -369 | -3072 -294 | -2372 -249 | 425 |
| 420(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 426 |
| 421(Q) | -705 -149 -16 | -1925 -500 -7108 | -199 233 -8150 | 2112 43 -894 | 917 -381 -1115 | -1534 399 -701 | -288 106 -1378 | -1824 -626 * | 42 210 * | -1842 -466 | -1054 -720 | -210 275 | -1709 394 | 2163 45 | -420 96 | -611 359 | -656 117 | -1502 -369 | -1997 -294 | -1291 -249 | 427 |
| 422(H) | -569 -149 -16 | -2048 -500 -7108 | 1450 233 -8150 | 1526 43 -894 | -2349 -381 -1115 | -1405 399 -701 | 1830 106 -1378 | -2103 -626 * | 181 210 * | -2058 -466 | -1157 -720 | -37 275 | -1569 394 | 272 45 | -349 96 | 713 359 | 620 117 | -1662 -369 | -2240 -294 | -1537 -249 | 428 |
| 423(C) | 1626 -149 -16 | 2878 -500 -7108 | -2671 233 -8150 | -2107 43 -894 | 1264 -381 -1115 | -1968 399 -701 | -1091 106 -1378 | 233 -626 * | -1777 210 * | -334 -466 | 250 -720 | -1672 275 | -2128 394 | -1459 45 | -1691 96 | -1096 359 | -529 117 | 1209 -369 | -1066 -294 | -704 -249 | 429 |

TABLE 7-continued

| | | | | | | | | | | | | | | | | | | | |
|---|---|---|---|---|---|---|---|---|---|---|---|---|---|---|---|---|---|---|---|
| 424(M) | -2042 | -1634 | -4379 | -3826 | -659 | -3976 | -2899 | 2765 | -3546 | 1204 | 3085 | -3605 | -3604 | -2896 | -3318 | -3183 | -1961 | 195 | -2135 | -2058 | 430 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 425(E) | 412 | -2447 | 1356 | 2379 | -2747 | -1477 | -445 | -2527 | -243 | -2477 | -1622 | -107 | 855 | -36 | -831 | -730 | -894 | -2073 | -2668 | -1906 | 431 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 426(A) | 2822 | -1031 | -2418 | -2539 | -3226 | 1898 | -2364 | -2941 | -2626 | -3229 | -2379 | -1722 | -2026 | -2302 | -2634 | -654 | -848 | -1983 | -3415 | -3226 | 432 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 427(I) | -1772 | -1325 | -4307 | -3877 | -1405 | -3993 | -3383 | 2935 | -3705 | 820 | -217 | -3632 | -3761 | -3400 | -3682 | -3260 | -1742 | 2033 | -2838 | -2525 | 433 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 428(L) | -875 | -1634 | -575 | 959 | -1581 | -1769 | -525 | -1179 | -135 | 1884 | -625 | -547 | -1931 | 1405 | -450 | -909 | -816 | -1074 | -1883 | -1383 | 434 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 429(A) | 1705 | -1826 | -180 | 949 | -2318 | -1410 | -359 | -2041 | -53 | -2067 | -1204 | 1001 | -1652 | 52 | -561 | 1232 | -595 | -1609 | -2298 | -1643 | 435 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 430(D) | -1074 | -2458 | 2381 | 60 | -2921 | 1927 | -658 | -2710 | -463 | -2675 | -1860 | -271 | -1918 | -276 | 866 | -915 | -1100 | -2245 | -2845 | -2124 | 436 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 431(K) | -688 | -2117 | 785 | 888 | -2469 | -1529 | -187 | -2189 | 2380 | -2106 | -1221 | -162 | -1661 | 256 | 1134 | -553 | -619 | -1760 | -2240 | -1607 | 437 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 432(I) | -2019 | -1582 | -4380 | -3941 | -1000 | -4086 | -3253 | 3295 | -3671 | 1100 | 145 | -3736 | -3783 | -3222 | -3556 | -3378 | -1976 | 657 | -2517 | -2289 | 438 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 433(Q) | -490 | -1797 | -369 | 171 | -2078 | -1457 | 1762 | -1779 | 1157 | -1780 | -905 | 1165 | -1550 | 1798 | -48 | -396 | -422 | 725 | -1986 | -1366 | 439 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 434(A) | 1954 | -1836 | 1733 | -180 | -2714 | -1429 | -806 | -2438 | -679 | -2518 | -1698 | -430 | 1775 | -448 | -1211 | -736 | -894 | -1923 | -2765 | -2117 | 440 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 435(G) | -2594 | -2690 | -3304 | -3623 | -4328 | 3747 | -3462 | -4761 | -3953 | -4671 | -4212 | -3320 | -3352 | -3748 | -3779 | -2839 | -2981 | -4004 | -3668 | -4222 | 441 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 436(D) | -1736 | -3455 | 3490 | 97 | -3737 | -1646 | -1070 | -3753 | -1363 | -3647 | -3016 | 1602 | -2204 | -760 | -2218 | -1420 | -1838 | -3213 | -3756 | -2780 | 442 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 437(V) | -1721 | -1302 | -4229 | -3874 | -1705 | -3894 | -3582 | 1607 | -3706 | -582 | -513 | -3610 | -3786 | -3559 | -3767 | -3209 | -1725 | 3294 | -3158 | -2712 | 443 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 438(V) | 594 | -988 | -3391 | -2911 | -1164 | -2888 | -2187 | 845 | -2637 | 765 | -154 | -2576 | -2962 | -2387 | -2622 | -2074 | -1205 | 2800 | -2084 | -1724 | 444 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 439(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 445 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |
| 440(I) | -1754 | -1308 | -4295 | -3867 | -1434 | -3978 | -3377 | 2661 | -3697 | 862 | -247 | -3617 | -3754 | -3406 | -3679 | -3243 | -1725 | 2373 | -2852 | -2526 | 446 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | | | | | | | | | | | | | |

TABLE 7-continued

| | | | | | | | | | | | | | | | | | |
|---|---|---|---|---|---|---|---|---|---|---|---|---|---|---|---|---|---|
| 441(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | 4056 96 | -3026 359 | -2913 117 | -3650 -369 | -3096 -294 | -3185 -249 | 447 |
| 442(Y) | -1321 -149 -16 | -1438 -500 -7108 | -1994 233 -8150 | -1608 43 -894 | 2186 -381 -1115 | 527 399 -701 | -450 106 -1378 | -1117 -626 * | -1481 210 * | -1211 -466 | -693 -720 | 1178 275 | -2522 394 | -1217 45 | -1665 96 | -1518 359 | -1275 117 | -1021 -369 | -198 -294 | 3178 -249 | 448 |
| 443(C) | -675 -149 -16 | 2205 -500 -7108 | -2544 233 -8150 | 972 43 -894 | -572 -381 -1115 | -2236 399 -701 | -1121 106 -1378 | 1373 -626 * | -1671 210 * | 679 -466 | 261 -720 | -1700 275 | -2270 394 | -1403 45 | -1668 96 | -1311 359 | -621 117 | 1601 -369 | -1150 -294 | -790 -249 | 449 |
| 444(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 450 |
| 445(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | -3352 394 | -3781 45 | -3695 96 | -3182 359 | -3279 117 | -4087 -369 | -3594 -294 | -4064 -249 | 451 |
| 446(K) | -1060 -149 -16 | -2058 -500 -7108 | -1088 233 -8150 | -460 43 -894 | -2432 -381 -1115 | -1917 399 -701 | -357 106 -1378 | -1970 -626 * | 2801 210 * | -1978 -466 | -1220 -720 | -632 275 | 4225 394 | 1339 45 | 367 96 | -999 359 | -946 117 | 536 -369 | -2145 -294 | -1717 -249 | 452 |
| 447(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 453 |
| 448(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 454 |
| 449(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 455 |
| 450(G) | -2594 -149 -16 | -2690 -500 -7108 | -3304 233 -8150 | -3623 43 -894 | -4328 -381 -1115 | 3747 399 -701 | -3462 106 -1378 | -4761 -626 * | -3953 210 * | -4671 -466 | -4212 -720 | -3320 275 | -3352 394 | -3748 45 | -3779 96 | -2839 359 | -2981 117 | -4004 -369 | -3668 -294 | -4222 -249 | 456 |
| 451(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 457 |
| 452(P) | -1659 -149 -16 | -2241 -500 -7108 | -2022 233 -8150 | -1646 43 -894 | -3185 -381 -1115 | -2242 399 -701 | -1373 106 -1378 | -3000 -626 * | -450 210 * | -2936 -466 | -2274 -720 | -1624 275 | 3435 394 | -1065 45 | 2095 96 | -1730 359 | -1750 117 | -2593 -369 | -2816 -294 | -2613 -249 | 458 |
| 453(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 459 |
| 454(M) | -2406 -149 -16 | -2296 -500 -7108 | -3638 233 -8150 | -3594 43 -894 | -1525 -381 -1115 | -3105 399 -701 | -2824 106 -1378 | -1047 -626 * | -3121 210 * | -596 -466 | 5043 -720 | -3293 275 | -3425 394 | -3046 45 | -2996 96 | -2911 359 | -2552 117 | -1398 -369 | -2513 -294 | -2207 -249 | 460 |
| 455(L) | -2871 -149 -16 | -2457 -500 -7108 | -4231 233 -8150 | -4103 43 -894 | -1033 -381 -1115 | -3803 399 -701 | -3165 106 -1378 | -541 -626 * | -3734 210 * | 3130 -466 | -31 -720 | -3965 275 | -3797 394 | -3286 45 | -3484 96 | -3713 359 | -2869 117 | -1136 -369 | -2394 -294 | -2220 -249 | 461 |
| 456(K) | 1368 -149 -16 | -1491 -500 -7108 | -763 233 -8150 | -332 43 -894 | -2319 -381 -1115 | -1417 399 -701 | -551 106 -1378 | -1998 -626 * | 1786 210 * | -2068 -466 | -1221 -720 | -500 275 | -1721 394 | -160 45 | -470 96 | 1631 359 | -587 117 | -1532 -369 | -2299 -294 | -1754 -249 | 462 |
| 457(P) | -1500 -149 -16 | -1738 -500 -7108 | -2514 233 -8150 | -2380 43 -894 | -1555 -381 -1115 | -2358 399 -701 | -2022 106 -1378 | -1126 -626 * | -2063 210 * | 1224 -466 | -841 -720 | -2189 275 | 3436 394 | -2061 45 | -2129 96 | -1822 359 | -1674 117 | -1231 -369 | -2290 -294 | -1878 -249 | 463 |

TABLE 7-continued

| | | | | | | | | | | | | | | | | | | |
|---|---|---|---|---|---|---|---|---|---|---|---|---|---|---|---|---|---|---|
| 458(T) | −351 −149 −16 | −974 −500 −7108 | −2208 233 −8150 | −2185 43 −894 | −2894 −381 −1115 | −1237 399 −701 | −2041 106 −1378 | −2561 −626 * | −2125 210 * | −2863 −466 | −2046 −720 | −1539 275 | −1948 394 | −1923 45 | −2218 96 | 1543 359 | 3230 117 | −1758 −369 | −3139 −294 | −2834 −249 | 464 |
| 459(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 465 |
| 460(M) | 2706 −149 −16 | −986 −500 −7108 | −2433 233 −8150 | −2144 43 −894 | −1502 −381 −1115 | −1684 399 −701 | −1706 106 −1378 | −700 −626 * | −1858 210 * | −968 −466 | 2744 −720 | −1705 275 | −2188 394 | −1713 45 | −1932 96 | −963 359 | −862 117 | −592 −369 | −2145 −294 | −1794 −249 | 466 |
| 461(I) | −2103 −149 −16 | −1659 −500 −7108 | −4461 233 −8150 | −3992 43 −894 | −869 −381 −1115 | −4152 399 −701 | −3233 106 −1378 | 3082 −626 * | −3723 210 * | 1619 −466 | 290 −720 | −3801 275 | −3788 394 | −3171 45 | −3557 96 | −3432 359 | −2046 117 | 487 −369 | −2418 −294 | −2265 −249 | 467 |
| 462(I) | −1761 −149 −16 | −1312 −500 −7108 | −4317 233 −8150 | −3954 43 −894 | −1713 −381 −1115 | −4027 399 −701 | −3703 106 −1378 | 3225 −626 * | −3814 210 * | −556 −466 | −498 −720 | −3712 275 | −3859 394 | −3653 45 | −3877 96 | −3344 359 | −1754 117 | 2110 −369 | −3216 −294 | −2787 −249 | 468 |
| 463(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 469 |
| 464(K) | 1641 −149 −16 | −2033 −500 −7108 | −323 233 −8150 | 914 43 −894 | −2415 −381 −1115 | −1565 399 −701 | −296 106 −1378 | −2097 −626 * | 2052 210 * | −2080 −466 | −1233 −720 | −257 275 | −1736 394 | 125 45 | −133 96 | −646 359 | −702 117 | −1707 −369 | −2258 −294 | −1657 −249 | 470 |
| 465(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 471 |
| 466(L) | −1699 −149 −16 | −1807 −500 −7108 | −2268 233 −8150 | −1925 43 −894 | −830 −381 −1115 | −2795 399 −701 | −1551 106 −1378 | −455 −626 * | −1225 210 * | 2510 −466 | 90 −720 | −1958 275 | −2845 394 | 1927 45 | −1308 96 | −2067 359 | −1651 117 | −846 −369 | −1841 −294 | −1454 −249 | 472 |
| 467(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 473 |
| 468(D) | −853 −149 −16 | −2415 −500 −7108 | 2115 233 −8150 | 1717 43 −894 | −2702 −381 −1115 | −1468 399 −701 | −378 106 −1378 | −2484 −626 * | 1085 210 * | −2417 −466 | −1546 −720 | −84 275 | −1732 394 | 41 45 | −699 96 | 696 359 | −824 117 | −2025 −369 | −2594 −294 | −1839 −249 | 474 |
| 469(S) | −892 −149 −16 | −1780 −500 −7108 | −931 233 −8150 | −688 43 −894 | −2757 −381 −1115 | −1643 399 −701 | −830 106 −1378 | −2472 −626 * | 1671 210 * | −2492 −466 | −1708 −720 | −799 275 | −2018 394 | −468 45 | −365 96 | 2676 359 | −1004 117 | −1981 −369 | −2598 −294 | −2130 −249 | 475 |
| 470(C) | −1135 −149 −16 | 3503 −500 −7108 | −3700 233 −8150 | −3406 43 −894 | −1670 −381 −1115 | −2549 399 −701 | −2675 106 −1378 | 653 −626 * | −3101 210 * | −916 −466 | −667 −720 | −2727 275 | −2925 394 | −2870 45 | −3030 96 | −1868 359 | −1288 117 | 2927 −369 | −2619 −294 | −2222 −249 | 476 |
| 471(A) | 2590 −149 −16 | −1035 −500 −7108 | −2404 233 −8150 | −2530 43 −894 | −3236 −381 −1115 | 2290 399 −701 | −2365 106 −1378 | −2954 −626 * | −2627 210 * | −3240 −466 | −2389 −720 | −1719 275 | −2027 394 | −2302 45 | −2637 96 | −656 359 | −851 117 | −1991 −369 | −3423 −294 | −3234 −249 | 477 |
| 472(L) | −2632 −149 −16 | −2152 −500 −7108 | −4630 233 −8150 | −4185 43 −894 | 1767 −381 −1115 | −4324 399 −701 | −2442 106 −1378 | −61 −626 * | −3879 210 * | 2789 −466 | 563 −720 | −3833 275 | −3823 394 | −2970 45 | −3513 96 | −3609 359 | −2518 117 | −738 −369 | −1527 −294 | −945 −249 | 478 |
| 473(I) | −2073 −149 −16 | −1632 −500 −7108 | −4434 233 −8150 | −3975 43 −894 | −911 −381 −1115 | −4130 399 −701 | −3238 106 −1378 | 3164 −626 * | −3706 210 * | 1451 −466 | 244 −720 | −3779 275 | −3785 394 | −3187 45 | −3557 96 | −3413 359 | −2021 117 | 546 −369 | −2449 −294 | −2273 −249 | 479 |
| 474(T) | −1213 −149 −16 | −1674 −500 −7108 | −2755 233 −8150 | −2906 43 −894 | −3163 −381 −1115 | −1922 399 −701 | −2659 106 −1378 | −2698 −626 * | −2788 210 * | −3105 −466 | −2612 −720 | −2311 275 | −2600 394 | −2708 45 | −2753 96 | −1463 359 | 3819 117 | −2197 −369 | −3286 −294 | −3156 −249 | 480 |

TABLE 7-continued

| | | | | | | | | | | | | | | | | | | |
|---|---|---|---|---|---|---|---|---|---|---|---|---|---|---|---|---|---|---|
| 475(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 481 |
| 476(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 482 |
| 477(R) | −2957 −149 −16 | −3022 −500 −7108 | −3318 233 −8150 | −2735 43 −894 | −3796 −381 −1115 | −2998 399 −701 | −1968 106 −1378 | −3912 −626 * | −846 210 * | −3631 −466 | −3157 −720 | −2611 275 | −3280 394 | −1724 45 | 4056 96 | −3026 359 | −2913 117 | −3650 −369 | −3096 −294 | −3185 −249 | 483 |
| 478(F) | −3342 −149 −16 | −2776 −500 −7108 | −4026 233 −8150 | −4232 43 −894 | 4354 −381 −1115 | −3545 399 −701 | −1431 106 −1378 | −2315 −626 * | −4038 210 * | −1801 −466 | −1900 −720 | −3299 275 | −3780 394 | −3350 45 | −3645 96 | −3490 359 | −3420 117 | −2566 −369 | −739 −294 | 349 −249 | 484 |
| 479(S) | −897 −149 −16 | −1462 −500 −7108 | −2333 233 −8150 | −2543 43 −894 | −3185 −381 −1115 | −1640 399 −701 | −2474 106 −1378 | −3294 −626 * | −2686 210 * | −3497 −466 | −2780 −720 | −1973 275 | −2360 394 | −2483 45 | −2703 96 | 3465 359 | −1316 117 | −2413 −369 | −3310 −294 | −3025 −249 | 485 |
| 480(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 486 |
| 481(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 487 |
| 482(T) | −359 −149 −16 | −976 −500 −7108 | −2225 233 −8150 | −2229 43 −894 | −2900 −381 −1115 | −1242 399 −701 | −2074 106 −1378 | −2560 −626 * | −2170 210 * | −2875 −466 | −2064 −720 | −1561 275 | −1958 394 | −1969 45 | −2247 96 | 1110 359 | 3375 117 | −1760 −369 | −3152 −294 | −2850 −249 | 488 |
| 483(Y) | −3402 −149 −16 | −2632 −500 −7108 | −3941 233 −8150 | −4011 43 −894 | 1064 −381 −1115 | −3924 399 −701 | 3388 106 −1378 | −2526 −626 * | −3541 210 * | −1996 −466 | −1973 −720 | −2625 275 | −3821 394 | −2664 45 | −3170 96 | −3135 359 | −3280 117 | −2619 −369 | −3420 −294 | 3756 −249 | 489 |
| 484(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 490 |
| 485(M) | −2322 −149 −16 | −1904 −500 −7108 | −4536 233 −8150 | −3951 43 −894 | 2387 −381 −1115 | 4112 399 −701 | −2676 106 −1378 | 67 −626 * | −3649 210 * | 2034 −466 | 3156 −720 | −3710 275 | −3633 394 | −2803 45 | −3311 96 | −3309 359 | −2204 117 | −588 −369 | −1794 −294 | −1586 −249 | 491 |
| 486(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 492 |
| 487(V) | −1771 −149 −16 | −1603 −500 −7108 | −3750 233 −8150 | −3689 43 −894 | −2037 −381 −1115 | −3050 399 −701 | −3231 106 −1378 | 403 −626 * | −3479 210 * | −1154 −466 | −1076 −720 | −3246 275 | −3399 394 | −3383 45 | −3437 96 | −2628 359 | −1917 117 | 3536 −369 | −3074 −294 | −2677 −249 | 493 |
| 488(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 494 |
| 489(H) | −3205 −149 −16 | −3079 −500 −7108 | −2723 233 −8150 | −2890 43 −894 | −2110 −381 −1115 | −3046 399 −701 | 5295 106 −1378 | −4135 −626 * | −2617 210 * | −3813 −466 | −3561 −720 | −2886 275 | −3482 394 | −2833 45 | −2620 96 | −3291 359 | −3356 117 | −3895 −369 | −2397 −294 | −1681 −249 | 495 |
| 490(V) | −1754 −149 −16 | −1297 −500 −7108 | −4329 233 −8150 | −3968 43 −894 | −1770 −381 −1115 | −4053 399 −701 | −3752 106 −1378 | 2604 −626 * | −3840 210 * | −621 −466 | −545 −720 | −3728 275 | −3878 394 | −3699 45 | −3917 96 | −3370 359 | −1746 117 | 2859 −369 | −3276 −294 | −2829 −249 | 496 |
| 491(A) | 2587 −149 −16 | −828 −500 −7108 | −2477 233 −8150 | −2155 43 −894 | −1837 −381 −1115 | −1468 399 −701 | −1728 106 −1378 | −743 −626 * | −1941 210 * | −1564 −466 | −954 −720 | −1607 275 | −2033 394 | −1725 45 | −2034 96 | −738 359 | 1178 117 | 1108 −369 | −2310 −294 | −1972 −249 | 497 |

TABLE 7-continued

| | | | | | | | | | | | | | | | | | | | | |
|---|---|---|---|---|---|---|---|---|---|---|---|---|---|---|---|---|---|---|---|---|
| 492(P) | −2931 −149 −16 | −2878 −500 −7108 | −3420 233 −8150 | −3706 43 −894 | −4181 −381 −1115 | −2925 399 −701 | −3468 106 −1378 | −4621 −626 * | −3859 210 * | −4490 −466 | −4165 −720 | −3491 275 | 4225 394 | −3781 45 | −3695 96 | −3182 359 | −3279 117 | −4087 −369 | −3594 −294 | −4064 −249 | 498 |
| 493(E) | −2641 −149 −16 | −3308 −500 −7108 | −896 233 −8150 | 3732 43 −894 | −3966 −381 −1115 | −2458 399 −701 | −2043 106 −1378 | −4105 −626 * | −2128 210 * | −4016 −466 | −3555 −720 | −1531 275 | −2959 394 | −1842 45 | −2560 96 | −2479 359 | −2750 117 | −3722 −369 | −3563 −294 | −3385 −249 | 499 |
| 494(A) | 3438 −149 −16 | −1472 −500 −7108 | −2846 233 −8150 | −3040 43 −894 | −3287 −381 −1115 | −1726 399 −701 | −2735 106 −1378 | −2840 −626 * | −3028 210 * | −3257 −466 | −2662 −720 | −2236 275 | −2447 394 | −2798 45 | −2944 96 | −1216 359 | −1387 117 | −2183 −369 | −3405 −294 | −3320 −249 | 500 |
| 495(Y) | −866 −149 −16 | −976 −500 −7108 | −1863 233 −8150 | −1331 43 −894 | 1353 −381 −1115 | −2145 399 −701 | 1318 106 −1378 | −556 −626 * | −1116 210 * | −777 −466 | −173 −720 | −1242 275 | −2197 394 | 1714 45 | −1301 96 | −1173 359 | −802 117 | 888 −369 | −445 −294 | 2749 −249 | 501 |
| 496(D) | 417 −149 −16 | −1831 −500 −7108 | 1647 233 −8150 | 1094 43 −894 | −2065 −381 −1115 | −1488 399 −701 | −353 106 −1378 | −1618 −626 * | −107 210 * | −1820 −466 | −1019 −720 | −189 275 | −1698 394 | 30 45 | −623 96 | −603 359 | −643 117 | 1629 −369 | −2154 −294 | −1520 −249 | 502 |
| 497(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 503 |
| 498(G) | −2594 −149 −16 | −2690 −500 −7108 | −3304 233 −8150 | −3623 43 −894 | −4328 −381 −1115 | 3747 399 −701 | −3462 106 −1378 | −4761 −626 * | −3953 210 * | −4671 −466 | −4212 −720 | −3320 275 | −3352 394 | −3748 45 | −3779 96 | −2839 359 | −2981 117 | −4004 −369 | −3668 −294 | −4222 −249 | 504 |
| 499(T) | 492 −149 −16 | −1190 −500 −7108 | −706 233 −8150 | −181 43 −894 | −1475 −381 −1115 | 311 399 −701 | −333 106 −1378 | −1099 −626 * | −81 210 * | 71 −466 | −509 −720 | 570 275 | 1113 394 | −6 45 | −509 96 | −450 359 | 1123 117 | −835 −369 | −1680 −294 | −1161 −249 | 505 |
| 500(I) | −2091 −149 −16 | −1746 −500 −7108 | −3971 233 −8150 | −3840 43 −894 | −1676 −381 −1115 | −3532 399 −701 | −3289 106 −1378 | 3684 −626 * | −3581 210 * | −659 −466 | −693 −720 | −3562 275 | −3674 394 | −3445 45 | −3521 96 | −3194 359 | −2146 117 | 449 −369 | −2877 −294 | −2493 −249 | 506 |
| 501(A) | 3103 −149 −16 | −1036 −500 −7108 | −2445 233 −8150 | −2572 43 −894 | −3222 −381 −1115 | 1051 399 −701 | −2380 106 −1378 | −2930 −626 * | −2650 210 * | −3226 −466 | −2381 −720 | −1739 275 | −2034 394 | −2327 45 | −2648 96 | −664 359 | −857 117 | −1981 −369 | −3412 −294 | −3228 −249 | 507 |
| 502(L) | −2239 −149 −16 | −1892 −500 −7108 | −3711 233 −8150 | −3400 43 −894 | 301 −381 −1115 | −3520 399 −701 | −1210 106 −1378 | −542 −626 * | −2948 210 * | 2564 −466 | −35 −720 | −2786 275 | −3395 394 | −2438 45 | −2750 96 | −2747 359 | −2165 117 | −945 −369 | −573 −294 | 2562 −249 | 508 |
| 503(V) | −1757 −149 −16 | −1387 −500 −7108 | −4101 233 −8150 | −3681 43 −894 | −1174 −381 −1115 | −3714 399 −701 | −3031 106 −1378 | 880 −626 * | −3410 210 * | 1254 −466 | −60 −720 | −3407 275 | −3585 394 | −3094 45 | −3354 96 | −2984 359 | −1743 117 | 3014 −369 | −2536 −294 | −2219 −249 | 509 |
| 504(Q) | −982 −149 −16 | −2251 −500 −7108 | −866 233 −8150 | 971 43 −894 | −2711 −381 −1115 | −1822 399 −701 | −252 106 −1378 | −2340 −626 * | 1444 210 * | −2194 −466 | −1356 −720 | −464 275 | −1885 394 | 2646 45 | 1632 96 | −858 359 | −863 117 | −1958 −369 | −2245 −294 | −1765 −249 | 510 |
| 505(E) | −1162 −149 −16 | −2771 −500 −7108 | 2137 233 −8150 | 2239 43 −894 | −3046 −381 −1115 | −1526 399 −701 | −626 106 −1378 | −2849 −626 * | −546 210 * | −2792 −466 | −1983 −720 | −145 275 | −1905 394 | −242 45 | −1192 96 | −940 359 | 1396 117 | −2385 −369 | −2990 −294 | −2169 −249 | 511 |
| 506(G) | −1707 −149 −16 | −2684 −500 −7108 | 1591 233 −8150 | −614 43 −894 | −3783 −381 −1115 | 3190 399 −701 | −1613 106 −1378 | −3795 −626 * | −1887 210 * | −3775 −466 | −3119 −720 | −915 275 | −2456 394 | −1358 45 | −2539 96 | −1610 359 | −1924 117 | −3150 −369 | −3636 −294 | −3124 −249 | 512 |
| 507(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 513 |
| 508(M) | −473 −149 −16 | −522 −500 −7108 | −1819 233 −8150 | −1236 43 −894 | −468 −381 −1115 | −1879 399 −701 | −687 106 −1378 | 1519 −626 * | −996 210 * | 566 −466 | 1677 −720 | −1154 275 | −1937 394 | 836 45 | −1131 96 | 1079 359 | −413 117 | 102 −369 | −957 −294 | −585 −249 | 514 |

TABLE 7-continued

| | | | | | | | | | | | | | | | | | | |
|---|---|---|---|---|---|---|---|---|---|---|---|---|---|---|---|---|---|---|
| 509(I) | −1761 −149 −16 | −1312 −500 −7108 | −4317 233 −8150 | −3954 43 −894 | −1713 −381 −1115 | −4027 399 −701 | −3703 106 −1378 | 3225 −626 * | −3814 210 * | −556 −466 | −498 −720 | −3712 275 | −3859 394 | −3653 45 | −3877 96 | −3344 359 | −1754 117 | 2110 −369 | −3216 −294 | −2787 −249 | 515 |
| 510(T) | 782 −149 −16 | −1467 −500 −7108 | −550 233 −8150 | 1029 43 −894 | −2202 −381 −1115 | −1425 399 −701 | −709 106 −1378 | −1791 −626 * | −472 210 * | −1993 −466 | −1203 −720 | −528 275 | −1787 394 | −368 45 | −902 96 | −617 359 | 2685 117 | −1400 −369 | −2333 −294 | −1783 −249 | 516 |
| 511(I) | −1766 −149 −16 | −1333 −500 −7108 | −4283 233 −8150 | −3923 43 −894 | −1635 −381 −1115 | −3967 399 −701 | −3619 106 −1378 | 3388 −626 * | −3759 210 * | −473 −466 | −437 −720 | −3672 275 | −3822 394 | −3576 45 | −3804 96 | −3285 359 | −1764 117 | 1695 −369 | −3126 −294 | −2717 −249 | 517 |
| 512(D) | −2784 −149 −16 | −3432 −500 −7108 | 4016 233 −8150 | −1200 43 −894 | −4140 −381 −1115 | −2466 399 −701 | −2197 106 −1378 | −4505 −626 * | −2621 210 * | −4365 −466 | −3956 −720 | −1551 275 | −3014 394 | −2039 45 | −3232 96 | −2593 359 | −2938 117 | −4046 −369 | −3710 −294 | −3552 −249 | 518 |
| 513(A) | 2705 −149 −16 | −1451 −500 −7108 | −1036 233 −8150 | −913 43 −894 | −2506 −381 −1115 | −1504 399 −701 | −1143 106 −1378 | −2174 −626 * | −794 210 * | −2337 −466 | −1613 −720 | −946 275 | −1993 394 | 2040 45 | −1061 96 | −809 359 | −910 117 | −1703 −369 | −2633 −294 | −2156 −249 | 519 |
| 514(H) | −615 −149 −16 | −1680 −500 −7108 | 1444 233 −8150 | 66 43 −894 | −1883 −381 −1115 | 168 399 −701 | 2650 106 −1378 | −1558 −626 * | −86 210 * | −1691 −466 | −891 −720 | −223 275 | −1680 394 | 31 45 | −577 96 | −571 359 | −585 117 | 1267 −369 | −2007 −294 | −1397 −249 | 520 |
| 515(K) | −654 −149 −16 | −2006 −500 −7108 | −546 233 −8150 | 42 43 −894 | −2376 −381 −1115 | −1581 399 −701 | −133 106 −1378 | −2066 −626 * | 1935 210 * | −1987 −466 | −1107 −720 | 1132 275 | −1658 394 | 1043 45 | 1058 96 | −540 359 | 1180 117 | −1660 −369 | −2113 −294 | −1532 −249 | 521 |
| 516(N) | −933 −149 −16 | −2085 −500 −7108 | −946 233 −8150 | −284 43 −894 | −2472 −381 −1115 | −1822 399 −701 | −253 106 −1378 | −2090 −626 * | 1711 210 * | 76 −466 | −1204 −720 | 1918 275 | −1876 394 | 175 45 | 1799 96 | −841 359 | −817 117 | −1755 −369 | −2132 −294 | −1663 −249 | 522 |
| 517(E) | −416 −149 −16 | −987 −500 −7108 | −843 233 −8150 | 1107 43 −894 | −1070 −381 −1115 | −1583 399 −701 | −338 106 −1378 | −623 −626 * | −183 210 * | 879 −466 | −172 −720 | −489 275 | −1679 394 | −94 45 | −565 96 | 544 359 | 813 117 | 265 −369 | −1379 −294 | −905 −249 | 523 |
| 518(I) | −2258 −149 −16 | −1804 −500 −7108 | −4588 233 −8150 | −4084 43 −894 | −706 −381 −1115 | −4269 399 −701 | −3231 106 −1378 | 2527 −626 * | −3807 210 * | 2292 −466 | 465 −720 | −3923 275 | −3814 394 | −3118 45 | −3570 96 | −3544 359 | −2181 117 | 190 −369 | −2303 −294 | −2237 −249 | 524 |
| 519(Q) | −477 −149 −16 | −1909 −500 −7108 | 958 233 −8150 | 282 43 −894 | −2211 −381 −1115 | −1389 399 −701 | 1484 106 −1378 | −1953 −626 * | 285 210 * | −1921 −466 | −1018 −720 | −32 275 | −1517 394 | 2318 45 | −225 96 | 630 359 | 559 117 | −1525 −369 | −2110 −294 | −1430 −249 | 525 |
| 520(L) | −2127 −149 −16 | −1743 −500 −7108 | −4402 233 −8150 | −3796 43 −894 | 1257 −381 −1115 | −3918 399 −701 | −2674 106 −1378 | 149 −626 * | −3492 210 * | 2527 −466 | 2164 −720 | −3553 275 | −3509 394 | −2714 45 | −3181 96 | −3095 359 | −2019 117 | 570 −369 | −1870 −294 | −1818 −249 | 526 |
| 521(N) | −723 −149 −16 | −2217 −500 −7108 | 958 233 −8150 | 236 43 −894 | −2518 −381 −1115 | −1466 399 −701 | 1611 106 −1378 | −2279 −626 * | 1719 210 * | −2217 −466 | −1334 −720 | 2285 275 | −1666 394 | 166 45 | −401 96 | −570 359 | −677 117 | −1837 −369 | −2382 −294 | −1678 −249 | 527 |
| 522(V) | −1754 −149 −16 | −1297 −500 −7108 | −4330 233 −8150 | −3968 43 −894 | −1770 −381 −1115 | −4053 399 −701 | −3752 106 −1378 | 2623 −626 * | −3841 210 * | −620 −466 | −545 −720 | −3729 275 | −3878 394 | −3699 45 | −3918 96 | −3371 359 | −1746 117 | 2846 −369 | −3277 −294 | −2830 −249 | 528 |
| 523(S) | 1545 −149 −16 | −974 −500 −7108 | −2003 233 −8150 | −1825 43 −894 | −2867 −381 −1115 | −1206 399 −701 | −1790 106 −1378 | −2580 −626 * | −1788 210 * | −2795 −466 | −1932 −720 | −1362 275 | 1826 394 | −1586 45 | −1999 96 | 2362 359 | −672 117 | −1755 −369 | −3057 −294 | −2721 −249 | 529 |
| 524(D) | −1776 −149 −16 | −3649 −500 −7108 | 3326 233 −8150 | 1869 43 −894 | −3838 −381 −1115 | −1642 399 −701 | −1031 106 −1378 | −3788 −626 * | −1322 210 * | −3660 −466 | −3029 −720 | −245 275 | −2192 394 | −711 45 | −2201 96 | −1425 359 | −1855 117 | −3264 −369 | −3821 −294 | −2816 −249 | 530 |
| 525(E) | 423 −149 −16 | −2950 −500 −7108 | 1944 233 −8150 | 2696 43 −894 | −3223 −381 −1115 | −1545 399 −701 | −718 106 −1378 | −3047 −626 * | −715 210 * | −2979 −466 | −2196 −720 | −161 275 | −1968 394 | −347 45 | −1403 96 | −1043 359 | −1314 117 | −2569 −369 | −3177 −294 | −2316 −249 | 531 |

TABLE 7-continued

| | | | | | | | | | | | | | | | | | |
|---|---|---|---|---|---|---|---|---|---|---|---|---|---|---|---|---|---|
| 526(E) | -2641 -149 -16 | -3308 -500 -7108 | -896 233 -8150 | 3732 43 -894 | -3966 -381 -1115 | -2458 399 -701 | -2043 106 -1378 | -4105 -626 * | -2128 210 * | -4016 -466 | -3555 -720 | -1531 275 | -2959 394 | -1842 45 | -2560 96 | -2479 359 | -2750 117 | -3722 -369 | -3563 -294 | -3385 -249 | 532 |
| 527(L) | -2339 -149 -16 | -1899 -500 -7108 | -4618 233 -8150 | -4042 43 -894 | 1570 -381 -1115 | -4204 399 -701 | -2849 106 -1378 | 1440 -626 * | -3758 210 * | 2558 -466 | 676 -720 | -3825 275 | -3700 394 | -2902 45 | -3418 96 | -3418 359 | -2226 117 | -382 -369 | -1924 -294 | -1778 -249 | 533 |
| 528(A) | 2338 -149 -16 | -1990 -500 -7108 | -241 233 -8150 | 938 43 -894 | -2395 -381 -1115 | -1557 399 -701 | -423 106 -1378 | -2061 -626 * | 954 210 * | -2103 -466 | -1286 -720 | -301 275 | -1791 394 | -26 45 | -375 96 | -717 359 | -784 117 | -1691 -369 | -2330 -294 | -1728 -249 | 534 |
| 529(R) | 524 -149 -16 | -2098 -500 -7108 | -789 233 -8150 | -146 43 -894 | -2504 -381 -1115 | -1729 399 -701 | 1632 106 -1378 | -2153 -626 * | 1229 210 * | -2054 -466 | -1204 -720 | -379 275 | -1789 394 | 1328 45 | 2313 96 | -719 359 | -724 117 | -1774 -369 | -2150 -294 | -1637 -249 | 535 |
| 530(R) | -2957 -149 -16 | -3022 -500 -7108 | -3318 233 -8150 | -2735 43 -894 | -3796 -381 -1115 | -2998 399 -701 | -1968 106 -1378 | -3912 -626 * | -846 210 * | -3631 -466 | -3157 -720 | -2611 275 | -3280 394 | -1724 45 | 4056 96 | -3026 359 | -2913 117 | -3650 -369 | -3096 -294 | -3185 -249 | 536 |
| 531(R) | -1895 -149 -16 | -2713 -500 -7108 | -2327 233 -8150 | -1192 43 -894 | -3484 -381 -1115 | -2502 399 -701 | -481 106 -1378 | -2856 -626 * | 2144 210 * | -2544 -466 | -1842 -720 | -1161 275 | -2458 394 | 1393 45 | 3023 96 | -1770 359 | -1619 117 | -2599 -369 | -2421 -294 | -2259 -249 | 537 |
| 532(A) | 2935 -149 -16 | -1714 -500 -7108 | -553 233 -8150 | 857 43 -894 | -2769 -381 -1115 | -1546 399 -701 | -1218 106 -1378 | -2333 -626 * | -1106 210 * | -2591 -466 | -1873 -720 | -809 275 | -2065 394 | -934 45 | -1502 96 | -954 359 | -1103 117 | -1872 -369 | -2898 -294 | -2374 -249 | 538 |
| 533(A) | 1291 -149 -16 | -1874 -500 -7108 | -176 233 -8150 | 1227 43 -894 | -2177 -381 -1115 | -1392 399 -701 | -109 106 -1378 | -1909 -626 * | 277 210 * | -1891 -466 | -995 -720 | 1134 275 | -1522 394 | 1248 45 | -228 96 | -361 359 | 562 117 | -1492 -369 | -2090 -294 | -1419 -249 | 539 |
| 534(W) | -805 -149 -324 | -687 -500 -7108 | -2581 233 -8150 | -2028 43 -894 | 138 -381 -1115 | -2236 399 -701 | -697 106 -1378 | 897 -626 * | -1681 210 * | -421 -466 | 141 -720 | -1645 275 | -2282 394 | -1369 45 | -1627 96 | -1315 359 | 636 117 | -90 -369 | 4479 -294 | 1809 -249 | 540 |
| 535(H) | -408 -149 -19 | -1801 -500 -6804 | -274 233 -8150 | 1284 43 -894 | -2096 -381 -1115 | -1385 399 -701 | 1500 106 -1378 | -1822 -626 * | 1168 210 * | -1802 -466 | -899 -720 | -33 275 | -1479 394 | 1381 45 | -102 96 | -303 359 | 595 117 | 221 -369 | -1996 -294 | -1339 -249 | 541 |
| 536(Q) | -650 -149 -16 | -1737 -500 -7108 | -627 233 -8150 | -72 43 -894 | -1981 -381 -1115 | -1615 399 -701 | -209 106 -1378 | -1625 -626 * | 1223 210 * | 392 -466 | -866 -720 | -318 275 | 1222 394 | 2120 45 | 50 96 | -598 359 | -572 117 | -1326 -369 | -1932 -294 | -1394 -249 | 542 |
| 537(P) | -2931 -149 -16 | -2878 -500 -7108 | -3420 233 -8150 | -3706 43 -894 | -4181 -381 -1115 | -2925 399 -701 | -3468 106 -1378 | -4621 -626 * | -3859 210 * | -4490 -466 | -4165 -720 | -3491 275 | 4225 394 | -3781 45 | -3695 96 | -3182 359 | -3279 117 | -4087 -369 | -3594 -294 | -4064 -249 | 543 |
| 538(A) | 2195 -149 -16 | -924 -500 -7108 | -968 233 -8150 | -546 43 -894 | -1397 -381 -1115 | -1356 399 -701 | -583 106 -1378 | -812 -626 * | -365 210 * | -1167 -466 | -487 -720 | -618 275 | -1660 394 | 1324 45 | -684 96 | -483 359 | -404 117 | 462 -369 | -1703 -294 | -1242 -249 | 544 |
| 539(P) | 411 -149 -16 | -1017 -500 -6804 | -1886 233 -8150 | -1616 43 -894 | -1600 -381 -1115 | -1588 399 -428 | -1411 -1961 -1378 | -962 -626 * | -1408 210 * | 495 -466 | -755 -720 | -1384 275 | 3156 394 | -1323 45 | -1577 96 | -847 359 | -785 117 | -783 -369 | -2111 -294 | -1716 -249 | 545 |
| 540(R) | -1612 -149 -16 | -2397 -500 -7108 | -2037 233 -8150 | -1033 43 -894 | -2897 -381 -1115 | -2352 399 -701 | -458 106 -1378 | -2365 -626 * | 2184 210 * | 665 -466 | -1520 -720 | -1051 275 | -2334 394 | -51 45 | 2602 96 | -1545 359 | -1395 117 | -2143 -369 | -2262 -294 | -2014 -249 | 546 |
| 541(Y) | 712 -149 -16 | -796 -500 -7108 | -2334 233 -8150 | -1883 43 -894 | -370 -381 -1115 | -2028 399 -701 | -986 106 -1378 | -143 -626 * | -1607 210 * | -663 -466 | -131 -720 | -1587 275 | -2243 394 | -1383 45 | -1656 96 | -1178 359 | -771 117 | 1114 -369 | -965 -294 | 3479 -249 | 547 |
| 542(T) | -527 -149 -16 | -1669 -500 -7108 | 1091 233 -8150 | -27 43 -894 | -2315 -381 -1115 | -1379 399 -701 | -443 106 -1378 | -2033 -626 * | -151 210 * | -2081 -466 | -1218 -720 | -282 275 | 557 394 | -41 45 | -650 96 | 1128 359 | 2077 117 | -1576 -369 | -2321 -294 | -1690 -249 | 548 |

TABLE 7-continued

| | | | | | | | | | | | | | | | | | | |
|---|---|---|---|---|---|---|---|---|---|---|---|---|---|---|---|---|---|---|
| 543(R) | −2957<br>−149<br>−16 | −3022<br>−500<br>−7108 | −3318<br>233<br>−8150 | −2735<br>−894 | −3796<br>−381<br>−1115 | −2998<br>399<br>−701 | −1968<br>106<br>−1378 | −3912<br>−626<br>* | −846<br>210 | −3631<br>−466 | −3157<br>−720 | −2611<br>275 | −3280<br>394 | −1724<br>45 | 4056<br>96 | −3026<br>359 | −2913<br>117 | −3650<br>−369 | −3096<br>−294 | −3185<br>−249 | 549 |
| — | | | | | | | | | | | | | | | | | | | | |
| 544(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210 | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 550 |
| — | | | | | | | | | | | | | | | | | | | | |
| 545(V) | −1747<br>−149<br>−16 | −1296<br>−500<br>−7108 | −4310<br>233<br>−8150 | −3948<br>43<br>−894 | −1758<br>−381<br>−1115 | −4023<br>399<br>−701 | −3716<br>106<br>−1378 | 2215<br>−626<br>* | −3813<br>210 | −615<br>−466 | −540<br>−720 | −3705<br>275 | −3860<br>394 | −3670<br>45 | −3887<br>96 | −3339<br>359 | −1741<br>117 | 3087<br>−369 | −3252<br>−294 | −2806<br>−249 | 551 |
| — | | | | | | | | | | | | | | | | | | | | |
| 546(L) | −2871<br>−149<br>−16 | −2457<br>−500<br>−7108 | −4231<br>233<br>−8150 | −4103<br>43<br>−894 | −1033<br>−381<br>−1115 | −3803<br>399<br>−701 | −3165<br>106<br>−1378 | −541<br>−626<br>* | −3734<br>210 | 3130<br>−466 | −31<br>−720 | −3935<br>275 | −3797<br>394 | −3286<br>45 | −3484<br>96 | −3713<br>359 | −2869<br>117 | −1136<br>−369 | −2394<br>−294 | −2220<br>−249 | 552 |
| — | | | | | | | | | | | | | | | | | | | | |
| 547(A) | 2404<br>−149<br>−16 | −890<br>−500<br>−7108 | −1926<br>233<br>−8150 | −1629<br>43<br>−894 | −1803<br>−381<br>−1115 | 1275<br>399<br>−701 | −1415<br>106<br>−1378 | −1282<br>−626<br>* | −1490<br>210 | 392<br>−466 | −963<br>−720 | −1316<br>275 | −1930<br>394 | −1328<br>45 | −1674<br>96 | −654<br>359 | −644<br>117 | −952<br>−369 | −2187<br>−294 | −1810<br>−249 | 553 |
| — | | | | | | | | | | | | | | | | | | | | |
| 548(K) | −2620<br>−149<br>−16 | −2961<br>−500<br>−7108 | −2461<br>233<br>−8150 | −2046<br>43<br>−894 | −3743<br>−381<br>−1115 | −2791<br>399<br>−701 | −1570<br>106<br>−1378 | −3603<br>−626<br>* | 3784<br>210 | −3387<br>−466 | −2839<br>−720 | −2048<br>275 | −3039<br>394 | −1260<br>45 | −465<br>96 | −2604<br>359 | −2536<br>117 | −3331<br>−369 | −3001<br>−294 | −2988<br>−249 | 554 |
| — | | | | | | | | | | | | | | | | | | | | |
| 549(Y) | −3621<br>−149<br>−16 | −2707<br>−500<br>−7108 | −4176<br>233<br>−8150 | −4424<br>43<br>−894 | 2950<br>−381<br>−1115 | −4049<br>399<br>−701 | −394<br>106<br>−1378 | −2539<br>−626<br>* | −4002<br>210 | −1942<br>−466 | −1987<br>−720 | −2749<br>275 | −3933<br>394 | −2854<br>45 | −3451<br>96 | −3299<br>359 | −3499<br>117 | −2690<br>−369 | 349<br>−294 | 4094<br>−249 | 555 |
| — | | | | | | | | | | | | | | | | | | | | |
| 550(A) | 3438<br>−149<br>−16 | −1472<br>−500<br>−7108 | −2846<br>233<br>−8150 | −3040<br>43<br>−894 | −3287<br>−381<br>−1115 | −1726<br>399<br>−701 | −2735<br>106<br>−1378 | −2840<br>−626<br>* | −3028<br>210 | −3257<br>−466 | −2662<br>−720 | −2236<br>275 | −2447<br>394 | −2798<br>45 | −2944<br>96 | −1216<br>359 | −1387<br>117 | −2183<br>−369 | −3405<br>−294 | −3320<br>−249 | 556 |
| — | | | | | | | | | | | | | | | | | | | | |
| 551(H) | −1741<br>−149<br>−16 | −2627<br>−500<br>−7108 | −2070<br>233<br>−8150 | −1046<br>43<br>−894 | −3303<br>−381<br>−1115 | −2401<br>399<br>−701 | 2713<br>106<br>−1378 | −2751<br>−626<br>* | 2478<br>210 | −2476<br>−466 | −1755<br>−720 | −1061<br>275 | −2375<br>394 | −27<br>45 | 2379<br>96 | −1621<br>359 | −1497<br>117 | −2477<br>−369 | −2379<br>−294 | −2161<br>−249 | 557 |
| — | | | | | | | | | | | | | | | | | | | | |
| 552(L) | −1014<br>−149<br>−16 | −876<br>−500<br>−7108 | −2956<br>233<br>−8150 | −2408<br>43<br>−894 | −582<br>−381<br>−1115 | −2550<br>399<br>−701 | −1529<br>106<br>−1378 | −2079<br>−626<br>* | 1721<br>210 | 2042<br>−466 | 345<br>−720 | −2114<br>275 | −2581<br>394 | −1775<br>45 | −2028<br>96 | 454<br>359 | −980<br>117 | 286<br>−369 | −1414<br>−294 | −1096<br>−249 | 558 |
| — | | | | | | | | | | | | | | | | | | | | |
| 553(V) | 933<br>−149<br>−16 | −842<br>−500<br>−7108 | −2818<br>233<br>−8150 | −2467<br>43<br>−894 | −1542<br>−381<br>−1115 | −1870<br>399<br>−701 | −1890<br>106<br>−1378 | 154<br>−626<br>* | −2226<br>210 | −1095<br>−466 | −617<br>−720 | −1932<br>275 | −2326<br>394 | −1995<br>45 | −2259<br>96 | −1126<br>359 | 1070<br>117 | 2769<br>−369 | −2180<br>−294 | −1826<br>−249 | 559 |
| — | | | | | | | | | | | | | | | | | | | | |
| 554(S) | −787<br>−149<br>−16 | −1522<br>−500<br>−7108 | −1486<br>233<br>−8150 | −1172<br>43<br>−894 | −2714<br>−381<br>−1115 | −1599<br>399<br>−701 | −1112<br>106<br>−1378 | −2500<br>−626<br>* | −433<br>210 | −2563<br>−466 | −1791<br>−720 | −1110<br>275 | −2067<br>394 | −796<br>45 | 1351<br>96 | 2916<br>359 | −989<br>117 | −1943<br>−369 | −2648<br>−294 | −2234<br>−249 | 560 |
| — | | | | | | | | | | | | | | | | | | | | |
| 555(S) | −326<br>−149<br>−16 | −1010<br>−500<br>−7108 | −1779<br>233<br>−8150 | −1541<br>43<br>−894 | −2691<br>−381<br>−1115 | −1234<br>399<br>−701 | −1566<br>106<br>−1378 | −2386<br>−626<br>* | −1486<br>210 | −2594<br>−466 | −1749<br>−720 | −1228<br>275 | 1196<br>394 | −1330<br>45 | −1747<br>96 | 2396<br>359 | 1967<br>117 | −1662<br>−369 | −2876<br>−294 | −2496<br>−249 | 561 |
| — | | | | | | | | | | | | | | | | | | | | |
| 556(A) | 3121<br>−149<br>−16 | −934<br>−500<br>−7108 | −2489<br>233<br>−8150 | −2561<br>43<br>−894 | −3081<br>−381<br>−1115 | −1203<br>399<br>−701 | −2295<br>106<br>−1378 | −2766<br>−626<br>* | −2533<br>210 | −3080<br>−466 | −2234<br>−720 | −1669<br>275 | −1953<br>394 | −2234<br>45 | −2533<br>96 | 936<br>359 | −746<br>117 | −1844<br>−369 | −3331<br>−294 | −3090<br>−249 | 562 |
| — | | | | | | | | | | | | | | | | | | | | |
| 557(S) | −897<br>−149<br>−16 | −1462<br>−500<br>−7108 | −2333<br>233<br>−8150 | −2543<br>43<br>−894 | −3185<br>−381<br>−1115 | −1640<br>399<br>−701 | −2474<br>106<br>−1378 | −3294<br>−626<br>* | −2686<br>210 | −3497<br>−466 | −2780<br>−720 | −1973<br>275 | −2360<br>394 | −2483<br>45 | −2703<br>96 | 3465<br>359 | −1316<br>117 | −2413<br>−369 | −3310<br>−294 | −3025<br>−249 | 563 |
| — | | | | | | | | | | | | | | | | | | | | |
| 558(R) | −586<br>−149<br>−16 | −1873<br>−500<br>−7108 | −516<br>233<br>−8150 | 979<br>43<br>−894 | −2188<br>−381<br>−1115 | −1543<br>399<br>−701 | −123<br>106<br>−1378 | −1869<br>−626<br>* | 1290<br>210 | −353<br>−466 | −980<br>−720 | −202<br>275 | −1622<br>394 | 314<br>45 | 1886<br>96 | −491<br>359 | 782<br>117 | −1495<br>−369 | −2024<br>−294 | −1439<br>−249 | 564 |
| — | | | | | | | | | | | | | | | | | | | | |
| 559(G) | −2594<br>−149<br>−16 | −2690<br>−500<br>−7108 | −3304<br>233<br>−8150 | −3623<br>43<br>−894 | −4328<br>−381<br>−1115 | 3747<br>399<br>−701 | −3462<br>106<br>−1378 | −4761<br>−626<br>* | −3953<br>210 | −4671<br>−466 | −4212<br>−720 | −3320<br>275 | −3352<br>394 | −3748<br>45 | −3779<br>96 | −2839<br>359 | −2981<br>117 | −4004<br>−369 | −3668<br>−294 | −4222<br>−249 | 565 |
| — | | | | | | | | | | | | | | | | | | | | |

TABLE 7-continued

| | | | | | | | | | | | | | | | | | | | | |
|---|---|---|---|---|---|---|---|---|---|---|---|---|---|---|---|---|---|---|---|---|
| 560(C) | 2804 | 3772 | -3185 | -3198 | -2739 | -1303 | -2462 | -2065 | -2882 | -2628 | -1924 | -1927 | -2044 | -2547 | -2727 | -661 | -799 | -1463 | -3099 | -2886 | 566 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | * | * | * | * | * | * | * | * | * | * | * | * | |
| 561(V) | -1771 | -1603 | -3750 | -3689 | -2037 | -3050 | -3231 | 403 | -3479 | -1154 | -1076 | -3246 | -3399 | -3383 | -3437 | -2628 | -1917 | 3536 | -3074 | -2677 | 567 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | * | * | * | * | * | * | * | * | * | * | * | * | |
| 562(T) | -1213 | -1674 | -2755 | -2906 | -3163 | -1922 | -2659 | -2698 | -2788 | -3105 | -2612 | -2311 | -2600 | -2708 | -2753 | -1463 | 3819 | -2197 | -3286 | -3156 | 568 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -16 | -7108 | -8150 | -894 | -1115 | -701 | -1378 | * | * | * | * | * | * | * | * | * | * | * | * | * | |
| 563(D) | -2784 | -3432 | 4016 | -1200 | -4140 | -2466 | -2197 | -4505 | -2621 | -4365 | -3956 | -1551 | -3014 | -2039 | -3232 | -2593 | -2938 | -4046 | -3710 | -3552 | 569 |
| — | -149 | -500 | 233 | 43 | -381 | 399 | 106 | -626 | 210 | -466 | -720 | 275 | 394 | 45 | 96 | 359 | 117 | -369 | -294 | -249 | |
| — | -21 | -6715 | -7757 | -894 | -1115 | -701 | -1378 | * | * | * | * | * | * | * | * | * | * | * | * | * | |
| 564(F) | -525 | -445 | -2202 | -1627 | 1946 | -2001 | -744 | 1247 | -1346 | 952 | 561 | 1079 | -2030 | -1067 | -1362 | -1067 | -465 | 338 | -714 | -230 | 570 |
| — | * | * | * | * | * | * | * | * | * | * | * | * | * | * | * | * | * | * | * | * | |
| — | * | * | * | * | * | * | * | * | 0 | | | | | | | | | | | | |

HMMER2.0 [2.2g]                                                                    Program name and version
NAME dhad_for_hmm                                                                  Name of the input sequence alignment file
LENG 564                                                                           Length of the alignment: include indels
ALPH Amino                                                                         Type of residues
MAP yes                                                                            Map of the match states to the columns of the alignment
COM /app/public/hmmer/current/bin/hmmbuild -F dhad-exp_hmm dhad_for_hmm.aln         Commands used to generate the file: this one means that hmmbuild (default patrameters) was applied to the alignment file
COM /app/public/hmmer/current/bin/hmmcalibrate dhad-exp_hmm                         Commands used to generate the file: this one means that hmmcalibrate (default parameters) was applied to the hmm profile
NSEQ 8                                                                             Number of sequences in the alignment file
DATE Tue Jun 3 10:48:24 2008                                                       When was the file generated
XT -8455 -4 -1000 -1000 -8455 -4 -8455 -4                                           The transition probability distribution for the null model (single G state)
NULT -4 -8455                                                                      The symbol emission probability distribution for the null model (G state); consists of K (e.g. 4 or 20) integers.
NULE 595 -1558 85 338 -294 453 -1158 197 249 902 -1085 -142 -21 -313 45 531 201 384 -199   The null probability used to convert these back to model probabilities is 1/K.
EVD -499.650970 0.086142                                                           The extreme value distribution parameters μ and lambda respectively; both floating point values. Lambda is positive and nonzero. These values are set when the model is calibrated with hmmcalibrate.

SEQUENCE LISTING (586 sequences)

SEQ ID NO: 1 - DNA, 1743 bp, Mycobacterium sp.
atgccctcaggaagttcaggaactcccgctgatgctcttcgcgcgagcgactcatcgccggacatcaagccccgcagccgcgacgtcaccgacggcctcgagaagaccgccgcccgcgggatgctgcgggcggtcggcatgggcgacgacgactgggtcaaaccgcagatcggcgtgggttcgtcgtggaacgagatcaccccgtgcaacatgtcgctgcaacggctggcgcagtcggtgaagggcggcgtgcactccgccggcggatttccgctggagttcggcacgatctcggtgtccgacggcatctcgatgggccacgagggcatgcacttctcgctggtctcgcgtgaggtgatcgccgacagcgtcgagaccgtcgtgcaggccgagcgtctcgacggcacggtgctgctggccggctgcgacaagtcgattcccggcatgctgatggccgccgcccggctcgacctggcctcggtcttcctgtacaacggttcgatcatgccgggcgtcgcgaagctcaccgacggctccgagcgggaagtcacgatcatcgacgccttcgaggcggtcggggcgtgcgcccgcgggctgatgtcccgcgaggacgtcgacatcatcgaacgggcgatctgtccgggtgagggcgcctgcggcggtatgtacaccgccaacaccatggcgtcggcggcggaagcgctcggcatgtcgttgccgggcagcgcatctcctgtggccatcgacaagcggcgcgacgagtacgcgcggaagtcgggtgaggcggtcgtcgagatgctgcgccgcggtatcaccgcccgcgacatcctcaccaaggaggccttcgagaacgcgatcgccgtcgtcatggcgttcggcggctccaccaacgccgtgctgcacctgctggccatcgcgtgggaggccaacgtgaagctcaccctcgaggacttcacccgcgtcgggcagaaggtgccgcacctcgccgacgtcaaaccgttcggccgtcacgtcatgaagcacgtcgacgagatcggcggtgtgcccgtggtgatgaaggcgctgctggacgccggactgctgcacggggactgcctcaccatcaccggcgagaccatggccgagaacctggcccacatcgaaccgccggacccggacggcaaggtgctgcgggcgatgaacaacccgatccacccgaccggcggcatcacgatcctgcacggatcgttggcgcccgagggcgcggtcgtgaagtcggcgggcttcgactccgacgtgttcgagggcaccgcaagggttttcgagcgggagcgggcagccctggacgcactcgaggacggcacgatcacccacggcgacgtcgtcgtcatccgctacgagggacccaagggcgggcccgggatgcgcgagatgctcgccatcaccggtgcgatcaagggtgccggcctgggcaaggacgtgctgctgatgaccgacggccggttctccggcggcaccaccggcctgtgcgtcgggcatatcgcccccgaggcggtcgacggcgggcccatcgcgttcgtgcgcgacggcgaccggatccggctcgacgtcgccaagggcacgctggacctcctggtcgacgaggccgaattcgagtcccgcaaagcgggattcgagccgttgcccccggtgtacaccaccggcgtgctggccaagtacacgaagttggtcgggtcggcggcggtcggcgcggtctgcggctag

SEQ ID NO: 2 - protein, 580 aa, Mycobacterium sp.
MPSGSSGTPADALRASDSSPDIKPRSRDVTDGLEKTAARGMLRAVGMGDDDWVKPQIGVGSSWNEITPCNMSLQRLAQSVKGGVHSAGGFPLEFGTISVSDGISMGHEGMHFSLVSREVIADSVETVVQAERLDGTVLLAGCDKSIPGMLMAAARLDLASVFLYNGSIMPGVAKLTDGSEREVTIIDAFEAVGACARGLMSREDVDIIERAICPGEGACGGMYTANTMASAAEALGMSLPGSASPVAIDKRRDEYARKSGEAVVEMLRRGITARDILTKEAFENAIAVVMAFGGSTNAVLHLLAIAWEANVKLTLEDFTRVGQKVPHLADVKPFGRHVMKHVDEIGGVPVVMKALLDAGLLHGDCLTITGETMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVAKGTLDLLVDEAEFESRKAGFEPLPPVYTTGVLAKYTKLVGSAAVGAVCG

SEQ ID NO: 3 - DNA, 1770 bp, Mycobacterium gilvum
atgtggccgatgaatcgacgggcgcataatcaccccatgccctcagactcacgctcgcattctcttcgcgcaagcggctcatcggtcgacatcaaaccccgcagccgcgacgtgaccgacgggctcgagcgcaccgccgcgcgcggcatgctgcgcgcggtcggcatgaccgacgacgactgggtcaagccccagatcggggtcggctcgtcgtggaacgagatcacgccgtgcaacatgtcgctgcagcggctggcccaggcggtcaagggcggtgtgcacgaggccgggggttacccgctggagttcggcacgatctccgtctccgacggcatctcgatgggccacgagggcatgcacttctcgctggtgtcccgcgaggtcatcgccgacagcgtcgagaccgtggtgcaggccgaacgcctcgacggcacggtgttgctggccggctgcgacaagtcgatccccggcatgctgatggccgcggcccgcctcgatctggcgagcgtgttcttctacaacggctcgatcatgccgggcgtcgcgaagctcaccgacggaagcgagaaggaagtcacgatcatcgacgccttcgaggcggtcggtgcgtgtgcgcgcgggctgatgtcgcgggaggacgtcgacatcatcgagcgggccatctgccccggtgagggcgcctgcggtggcatgtacaccgccaacacgatggcctcggccgccgaggcgctcggcatgtcgctgccgggcagcgcgtctccggtggcgatcgacaagcggcgcgacgactttgcgcgccgctccggcgaggcggtggtcgagatgctgcgtcgcggcatcaccgcccgcgacatcctgaccaaggaggccttcgagaacgcgatcgccgtcgtgatggccttcggcggttccaccaacgcggtgctgcatctgctggccatcgcgtgggaggcgcaggtcgagctgacgctggcggacttcacccggatcgggcagaaggtgccgcacctggcggatgtgaagccgttcggcgcgtacgtgatgaagcacgtcgacgagatcggcggcgtgccggtggtgatgcgggcactgctcgacgccggactgctgcacggggactgcctcacggtgaccggtcagacgatggccgagaacctggcccacatcgagccgccggaccccgacggcaaggtgctgcgggcgatgaacaacccgatccacccgaccggcggcatcacgatcctgcacggatcgctggcccccgagggcgcggtggtcaagtcggccggcttcgactccgacgtgttcgagggcaccgcacgggttttcgagcgcgaacgggcggcgctcgacgcgctggaggacggcacgatcacccacggcgacgtcgtcgtcatccgttacgagggccccaagggcggcccggggatgcgcgagatgctggcgatcaccggtgcgatcaagggcgccgggctgggcaaggacgtgctgctgatgaccgacggacggttctcgggcgggacgacgggtctgtgcgtcgggcacatcgcgccggaggccgtcgacggcggaccgatcgcattcgtgcgtgacggggacaggatccggttggacgtcgccaacggcacgctggacatcctcgtcgacgaggccgagttcgaatcgcgcaaggcgggcttcgaaccgctgccgccggtctacacgacgggggtgctcgccaagtacacgaagctggtgggttcggcggcggtcggcgcggtctgcagttag

SEQ ID NO: 4 - protein, 589 aa, Mycobacterium gilvum
MWPMNRRAHNHPMPSDSRSHSLRASGSSVDIKPRSRDVTDGLERTAARGMLRAVGMTDDDWVKPQIGVGSSWNEITPCNMSLQRLAQAVKGGVHEAGGYPLEFGTISVSDGISMGHEGMHFSLVSREVIADSVETVVQAERLDGTVLLAGCDKSIPGMLMAAARLDLASVFFYNGSIMPGVAKLTDGSEKEVTIIDAFEAVGACARGLMSREDVDIIERAICPGEGACGGMYTANTMASAAEALGMSLPGSASPVAIDKRRDDFARRSGEAVVEMLRRGITARDILTKEAFENAIAVVMAFGGSTNAVLHLLAIAWEAQVELTLADFTRIGQKVPHLADVKPFGAYVMKHVDEIGGVPVVMRALLDAGLLHGDCLTVTGQTMAENLAHIEPPDPDGKVLRAMNNPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFVRDGDRIRLDVANGTLDILVDEAEFESRKAGFEPLPPVYTTGVLAKYTKLVGSAAVGAVCS

SEQ ID NO: 5 - DNA, 1716 bp, Mycobacterium smegmatis
atgccctcagacgacaagtccactgagactcctgacatcaagccccgcagtcgcgacgtcaccgacggcctcgagaaggcggccgcccgtgggatgctccgtgcggtaggcatgggcgacgccgactgggccaagccgcagatcggcgtcgggtcgtcgtggaacgagatcacgccgtgcaacatgtcgctgcagcgcctcgcgaagtcggtcaaggacggcgtccacgaggcgggcggctacccgctcgaattcggcaccatctcggtgtccgacggcatctcgatgggccacgagggcatgcacttctcgctggtctcgcgcgaggtgatcgccgacagcgtcgagaccgtcgtgcaggccgagcgcctcgacggcacggtcctgctggccggctgcgacaagtccattccgggcatgctcatggctgccgcgcggctggacctcgcctcggtgttcttctacaacggctcgatcatgccgggtgtcgcgaagctgaccgacggcaccgagaaggaagtcacgatcatcgacgcgttcgaggccgtcggcgcgtgcgtgcgcggcctgatgtcgcgtgaggacgtcgacatcatcgagcgcgcgatctgccccggcgagggtgcctgcggcggcatgtacaccgccaacaccatggccagcgccgccgaggccctcggcctgtcgctgcccggcagcgcgtcgccggtcgccatcgacaagcgccgcgacgagttcgcgcgccgctccggcgaggccgtcgtcgacatgctgcgtcgcggcatcaccgctcgcgacatcctcaccaaggaggccttcgagaacgccatcgccgtggtcatggcgttcggcgggtccaccaacgccgtgctgcacctgctggcgatcgcccgcgaggccgaggtggagctgacgctcgacgatttcacgcgcgtcggcagcaaggtcccgcacctcgcggacgtcaagccgttcggccgccatgtcatgaagcacgtcgacgagatcggcggtgtgcccgtggtgatgcgcgctctgctggatgccggtctgctgaacggcgagtgcctgacggtcacgggcaagaccatggccgagaacctggcccacatcgctcccccggatcccgacggcaaggtgctgcgggccatgaacaacccgatccacccgaccggcggcatcacgatcctgcacggctcgctcgctcccgagggtgcggtggtcaagtcagccggcttcgattcggacgtgttcgagggcactgcaagggttttcgaccgcgaacgtgccgcgatggacgcgctcgaggacggcaccatccaggcgggcgacgtcgtggtgatccgctacgagggccccaagggcggtcccggtatgcgcgagatgctcgcgatcaccggcgccatcaagggtgcgggtctgggcaaggacgtgctgctgatgaccgacggtcggttctcgggcggtacgacgggtctgtgcgtcgggcacatcgcgccggaggccgtcgacggcggcccgatcgcgttcgtgcgcgacggtgaccgcatccgcctcgacgtcgccaagggcacgctcgacgtgctcgtcgacgaagaagagttcgaggcccgcaaggccggcttcgaacccctgccgccgcggtacaagaccggtgtgctggccaagtacaccaagctggtccagtccgccgccgtcggcgcagtctgcacctaa

SEQ ID NO: 6 - protein, 571 aa, Mycobacterium smegmatis
MPSDDKSTETPDIKPRSRDVTDGLEKAAARGMLRAVGMGDADWAKPQIGVGSSWNEITPCNMSLQRLAKSVKDGVHEAGGYPLEFGTISVSDGISMGHEGMHFSLVSREVIADSVETVVQAERLDGTVLLAGCDKSIPGMLMAAARLDLASVFFYNGSIMPGVAKLTDGTEKEVTIIDAFEAVGACVRGLMSREDVDIIERAICPGEGACGGMYTANTMASAAEALGLSLPGSASPVAIDKRRDEFARRSGEAVVDMLRRGITARDILTKEAFENAIAVVMAFGGSTNAVLHLLAIAREAEVELTLDDFTRVGSKVPHLADVKPFGRHVMKHVDEIGGVPVVMRALLDAGLLNGECLTVTGKTMAENLAHIAPPDPDGKVLRAMNNPIHPTGGITILHGSLAPEGAVVKSAGFDSDVFEGTARVFDRERAAMDALEDGTIQAGDVVVIRYEGPKGGPGMREMLAITGAIKGAGLGKDVLLMTDGRFSGGTTGLCVGHIAPEAVDGGPIAFVRDGDRIRLDVAKGTLDVLVDEEEFEARKAGFEPLPPRYKTGVLAKYTKLVQSAAVGAVCT

SEQ ID NO: 7 - DNA, 1698 bp, Mycobacterium vanbaalenii
atgccctcatcgccagacatcaagccccgtagccgcgacgtcaccgacggcctggagaaggccgccgcccggggaatgctgcgcgcggtaggcatgggcgacgaggacttcgccaaaccgcagatcggcgtcggctcgtcctggaacgagatcaccccgtgcaacctgtcgctggaccggctcgccaaggcggtcaaggaaggcgtcttcgaggccggcggcttcccgatggagttcggcaccatctcggtttccgacggcatctcgatgggccatgaaggcatgcacttttcgttggtgtcgcgcgagatcatcgccgacagcgtcgagacggtgatgcaggccgagcgtctggacggctcggtgctgctcgccggatgcgacaagtcgctgcccggcatgctgatggccgctgcgcggctcgacctggccagcgtttttctctacgccggctcgatcctgcccggccgggtcaagctgtccgacggcagcgagaaggacgtcacgatcatcgacgccttcgaggccgtcggcgcctgcgcgcgcgggctgatgccccgcgaggacgtcgacgccatcgagcgtgcgatctgcccgggtgaaggcgcctgcggcggcatgtacaccgccaacacgatggccagcgccgccgaggcgctcggcatgtcgctgcccggctccgccgccccgccggccaccgaccggcgccgcgacggcttcgcccgcaagagcggcatggccgtcgtcgaactgctgcgccgaggcatcaccgcccgcgacatcctgaccaaggaggcgttcgagaacgcgatcgcggtcgtgatggcgttcggcggctccaccaacgcggtgctgcacctgctcgcgatcgcctacgaggccaacgtcaagctgaccctggaggacttcacccgcgtcggcgccaaggtgccgcacctggccgacgtgaaaccgttcggcgcgtacgtgatgaacgacgtcgaccggatcggcggcgttccggtcgtgatgaaggctctgctggacgccggtctgctgcacggggactgcctcaccgtcaccggtaagacgatggccgagaaccttgcccacatcgccccgcccgaccccgacggcaaggtgctgcgcgctctcagcaggccgatccatcccaccggcggcatcacgatcctgcacggctcgctggctcccgaaggtgcggtggtgaagtccgccgggttcgactccgacgtgttcgaaggcaccgcaagggttttcgagcgtgaacgggcagcgctcgacgcgctggaggacggcaccatcacgcacggcgacgtcgtggtcatccgttacgagggccccaagggcggtccgggcatgcgcgaaatgctcgccatcacaggcgcaatcaagggcgccgggctcggcaaggatgtgctgttgatgaccgacggccggttctccggcggcaccaccggtctgtgcgtcggccacatcgccccggaagcggtcgacggcggacccatcgccttcatcaaggacggcgacaagatccgtctcgacgtggccaagggcaccctcgacgttgtggtcgacaaggacgaattcgaggcgcgcaaagtcgggttcgagccgcttccccccgtctacaccaccggggtgctggccaagtacaccaagctcgtcggctcggcggccaccggcgcggtctgcacgtag

SEQ ID NO: 8 - protein, 565 aa, Mycobacterium vanbaalenii
MPSSPDIKPRSRDVTDGLEKAAARGMLRAVGMGDEDFAKPQIGVGSSWNEITPCNLSLDRLAKAVKEGVFEAGGFPMEFGTISVSDGISMGHEGMHFSLVSREIIADSVETVMQAERLDGSVLLAGCDKSLPGMLMAAARLDLASVFLYAGSILPGRVKLSDGSEKDVTIIDAFEAVGACARGLMPREDVDAIERAICPGEGACGGMYTANTMASAAEALGMSLPGSAAPPATDRRRDGFARKSGMAVVELLRRGITARDILTKEAFENAIAVVMAFGGSTNAVLHLLAIAYEANVKLTLEDFTRVGAKVPHLADVKPFGAYVMNDVDRIGGVPVVMKALLDAGLLHGDCLTVTGKTMAENLAHIAPPDPDGKVLRALSRPIHPTGGITILHGSLAPEGAVVKSAGFDSDVFEGTARVFERERAALDALEDGTITHGDVVVIRYEGPKGGPGMREMLAITGAIKGAGLGKDVLLMTDGRFSGGTTGLCVGHIAPEAVDGGPIAFIKDGDKIRLDVAKGTLDVVVDKDEFEARKVGFEPLPPVYTTGVLAKYTKLVGSAATGAVCT

SEQ ID NO: 9 - DNA, 1707 bp, Nocardia farcinica
gtggccgagcagacgaacacccccgacctcaagccccgcagccgcgacgtcaccgacgggctggaacgcaccgccgcccgcggcatgctgcgcgcggtgggcatgggcgacgacgactgggagaagccgcagatcggcgtcgcctcctcctggaacgagatcaccccgtgcaacctgtcgctggaccggctcgcgcagggctgcaaggacggcgtgttcgccgccggtggcttcccgatgcagttcggcaccatctcggtctccgacggcatctcgatgggccacgagggcatgcacttctcgctggtgtcgcgcgaagtgatcgccgacagcgtggagacggtgatgcaggccgagcggctcgacggctcggtgctgctggccgggtgcgacaagtcgctgcccggcatgctgatggccgcggcccgcctcgacctggccagcgtgttcctctacgcgggctcgatcctgcccggcatcgccaagctctccgacggcaccgagcgcgaggtgacgatcatcgacgcgttcgaggcggtcggagcgtgcgcgcgcgggctgatgagccgggccgacgtcgacgccatcgaacgcgcgatctgtcccggcgagggcgcctgcggcggcatgtacaccgccaacacgatggccagcgcggccgaggcgctgggcatgtcgctgcccggcagcgccgcaccgcccgccaccgaccgccgccgcgacgggtacgcccgccgcagcggtcaggccgtggtcgagctgctgcgccgcggcatcaccgcccgcgacatcctcaccaaggaggcgttcgagaacgccatcgcggtggtgatggccttcggcggctcgaccaacgcggtgctgcacttgctcgcgatcgcgcacgaggcgcgggtggagctcaccctcgacgatttcgcgcgggtgggcaggcgggtgccgcacctggccgacgtcaagccgttcggcgcgcatgtgatgaccgatgtcgaccgcatcggcggcgtgccggtgatgatgaagaccctgctcgacgccgggctgctgcacggtgactgcctcaccgtcaccggccgcaccgtcgcggagaacctcgcccacatcgccccgcccgacccggacggcaaggtggtgcgcgcgctgaacgatccgatccatcccaccggcggcatcaccatcctgtccggctcgctggcgcccggcggggcggtggtgaaatccgccggtttcgacgaggacgtcttcaccggcacggccagggtcttcgatcgcgaacgcgccgcgatggacgcgctcgaggacggcaccatcaccgcaggcgacgtggtggtcatccgctacgagggccccaagggcggacccggcatgcgcgagatgctggccatcaccgccgccatcaagggcgcgggcctgggcaaggacgtgctgctgctcaccgacggccgcttctccggtggcaccaccggactgtgtgtcgggcacgtcgcgcccgaggcggtggacggtggtccgatcgcgttcgtccgcgacggcgaccgcatccggctcgacgtggccgcgggcaccctggacctgctggtggagcccgccgaactcgagcggcgcaaacaggactggcgaccgctgccgccgcgctacacccgcggcgtgctcgccaagtacaccaagctggtcggttcggcctcggtcggcgcggtctgcgactga

SEQ ID NO: 10 - protein, 568 aa, Nocardia farcinica
MAEQTNTPDLKPRSRDVTDGLERTAARGMLRAVGMGDDDWEKPQIGVASSWNEITPCNLSLDRLAQGCKDGVFAAGGFPMQFGTISVSDGISMGHEGMHFSLVSREVIADSVETVMQAERLDGSVLLAGCDKSLPGMLMAAARLDLASVFLYAGSILPGIAKLSDGTEREVTIIDAFEAVGACARGLMSRADVDAIERAICPGEGACGGMYTANTMASAAEALGMSLPGSAAPPATDRRRDGYARRSGQAVVELLRRGITARDILTKEAFENAIAVVMAFGGSTNAVLHLLAIAHEARVELTLDDFARVGRRVPHLADVKPFGAHVMTDVDRIGGVPVMMKTLLDAGLLHGDCLTVTGRTVAENLAHIAPPDPDGKVVRALNDPIHPTGGITILSGSLAPGGAVVKSAGFDEDVFTGTARVFDRERAAMDALEDGTITAGDVVVIRYEGPKGGPGMREMLAITAAIKGAGLGKDVLLLTDGRFSGGTTGLCVGHVAPEAVDGGPIAFVRDGDRIRLDVAAGTLDLLVEPAELERRKQDWRPLPPRYTRGVLAKYTKLVGSASVGAVCD

SEQ ID NO: 11 - DNA, 1695 bp, Rhodococcus sp.
atgagtaccccggatcccaaaccccgcagccgtgacgtcaccgacggattggagaagaccgcagcgcgcggaatgctccgtgcggtgggcatgggcgacgacgactgggggaaatcccagatcggcgtggcgtcgtcctggaacgagatcaccccctgcaacctgtcgctcgaccggctcgcgaaggccgtcaaggacggcgtccacgccgcaggcgggtatcccctcgagttcggcaccatctccgtgtccgacggcatctcgatgggacacgagggcatgcacttctccctcgtctcccgtgaggtgatcgccgacagcgtggaaacggtgatgcaggccgaacgcctcgacgggtcggtgctcctcgccggttgcgacaagtccctgcccggcatgctgatggccgcggcccgcctcgacctcgcgagcgtgttcctctacgccggttcgatcctgcccggtgtcgcaaaaatgtccgacggcaccgaacgcgacgtcaccatcatcgacgcgttcgaggcggtcggcgcctgttcgcgcggactgatgagccgtgaggacgtcgacgccatcgagcgtgccatctgtcccggcgagggcgcgtgcggcggaatgtacaccgcgaacacgatggccagtgccgccgaggcgctcggcatgtcgctgcccggcagcgcctccccgcccgccaccgaccgtcgtcgcgacggattcgcgaggcgcagcggtgaagccgtcgtcgaactgctccgccgcggcatcaccgccagggacatcctcaccaaggaagcgttcgagaacgccatcgccgtggtcatggccttcggcggttccaccaacgccgtcctgcacctgctggcgatcgcgagcgaagcggatgtggaactgaccctcgacgacttctcccgcgtcggcgcccgcgtcccgcacctcgcggacgtcaaaccgttcggcaagcacgtgatgaaggacgtcgaccacatcggcggcgtccccgtcatcatgaaggccctgctcgacgccgggatgctgcacggcgactgcctcaccgtcaccggcaagaccatggccgagaacctgtcggccatcgcccctcccgacccggacggcaaggtgctccgcgcgatgagttcgcccatccacccgaccggcggaatcacgatcctcaaggggtccctcgccccgggcggcgcggtggtgaagtcggccgggttcgactccgacgtcttcaccggcaccgcccgcgtcttcgaacgggaacgcgccgcgatggatgccctcgaggacggcaccatcacgaacggcgacgtcgtggtcatccgctacgagggccccaagggcggtcccggcatgcgcgagatgctcgcgatcaccggcgcgatcaagggcgccgggctgggcaaggacgtcctcctgctcaccgacggccgattctccggcggcaccaccggcctgtgcgtcggccacgtggcaccggaagccgtcgacggcggtcccatcgcgttcgtccgcgacggcgaccagatccgactggacgtcggaacgggcaccctcgaactgctcgtcgacgaagaggaactcgccggccgcaagaacgggtgggagcctctgcccccgcgctacacccgcggggtcctggccaagtacacgaagctcgtcggttccgcctcgggcggcgccgtctgcgggtag

SEQ ID NO: 12 - protein, 564 aa, Rhodococcus sp.
MSTPDPKPRSRDVTDGLEKTAARGMLRAVGMGDDDWGKSQIGVASSWNEITPCNLSLDRLAKAVKDGVHAAGGYPLEFGTISVSDGISMGHEGMHFSLVSREVIADSVETVMQAERLDGSVLLAGCDKSLPGMLMAAARLDLASVFLYAGSILPGVAKMSDGTERDVTIIDAFEAVGACSRGLMSREDVDAIERAICPGEGACGGMYTANTMASAAEALGMSLPGSASPPATDRRRDGFARRSGEAVVELLRRGITARDILTKEAFENAIAVVMAFGGSTNAVLHLLAIASEADVELTLDDFSRVGARVPHLADVKPFGKHVMKDVDHIGGVPVIMKALLDAGMLHGDCLTVTGKTMAENLSAIAPPDPDGKVLRAMSSPIHPTGGITILKGSLAPGGAVVKSAGFDSDVFTGTARVFERERAAMDALEDGTITNGDVVVIRYEGPKGGPGMREMLAITGAIKGAGLGKDVLLLTDGRFSGGTTGLCVGHVAPEAVDGGPIAFVRDGDQIRLDVGTGTLELLVDEEELAGRKNGWEPLPPRYTRGVLAKYTKLVGSASGGAVCG

SEQ ID NO: 13 - DNA, 1695 bp, Mycobacterium ulcerans
atgccagaagccgatatcaagccccgtagccgcgacgtcactgacggactggaaaaagccgctgcccgtggcatgttgcgggcggtaggcatggtcgacgaagacttcgccaaggcacagatcggggttgcctcgtcctggaacgagattacgccgtgcaacctctcgctggaccggctggccaagtcggtgaaagagggggtgttcgccgcgggcggctacccgcttgagttcggcacgatttcggtctccgacggcatttcgatgggtcacgagggcatgcacttctccctggtgtcgcgcgaagtgatcgccgacagcgtggaaaccgtgatgcaggccgagcgcctcgacggctcggtgctgctggccggatgcgacaaatccctgcccggaatgctgatggccgccgcccgtttggatttggcgtcggtgtttctctacgcgggctcgatccttccgggggtcgccaagctctccgacggcagcgaacgcgaggtcaccatcatcgacgcgttcgaagcggtcggcgcgtgctcgcgagggttgatgagccgagccgacgtcgacgccatcgagcgcgcgatctgccccggcgagggtgcctgtggcgggatgtacacggccaacacgatggccagtgccgctgaagcacttggcatgtcgctgccgggcagcgcggcgcccccggccaccgaccgccgccgcgacgggttcgcccggcaaagcggtcaagccgtcatcgaattgctgcgccagggcattaccgctcgcgacatcatgacccgggaggcgttcgagaacgccatcgcggtggtgatggcattcggcggctcgaccaatgcggtgctgcacctgctggcgatcgcccatgaggccaacgtcgagctcacgctcgacgacttcagccggatcggctcgaaggtgccgcacctagccgatgtcaagccgttcggccgccatgtgatgtcccacgtcgaccacatcggcggtgtgccggtggtcatgaagactttgctggatgccggcctgctgcacggggattgcctgaccgtgaccggccggaccgtggccgagaacctggaggccattgctccgccggacccggacggcaaggtgctacgcgcgctgatcaacccgatccatgcgaccgggggcatcaccatcctgcgtggatccctggcccccgaaggtgccgtggtcaagacggccggcttggacaccgatgtattcgaaggaacggcacgggttttcgacggcgagcgggccgcgctggatgccctcgaggacggcaccatcacccacggtgacgtggtggtgatccgttacgagggacccaagggcggccccgggatgcgggagatgctcgccatcaccggcgcgatcaagggcgccgggctcggcaaagacgtgctgctgttgaccgacggtcgattctccggcggcacaacgggcttctgtgtgggacacatcgcacccgaggcggtggatgccggaccgatcgcgttcgtgcgcgacggcgaccggatccggctcgacgttgccggccggacgctcgacgttctgaccgacccgccagagttcgcggcccgtcaacagaatttcactcctccggcgccgcgttacaagaccggcgtactggccaagtacgtcaagctggtcggctccgccgcgatcggcgcggtctgcggctaa

SEQ ID NO: 14 - protein, 564 aa, Mycobacterium ulcerans
MPEADIKPRSRDVTDGLEKAAARGMLRAVGMVDEDFAKAQIGVASSWNEITPCNLSLDRLAKSVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACSRGLMSRADVDAIERAICPGEGACGGMYTANTMASAAEALGMSLPGSAAPPATDRRRDGFARQSGQAVIELLRQGITARDIMTREAFENAIAVVMAFGGSTNAVLHLLAIAHEANVELTLDDFSRIGSKVPHLADVKPFGRHVMSHVDHIGGVPVVMKTLLDAGLLHGDCLTVTGRTVAENLEAIAPPDPDGKVLRALINPIHATGGITILRGSLAPEGAVVKTAGLDTDVFEGTARVFDGERAALDALEDGTITHGDVVVIRYEGPKGGPGMREMLAITGAIKGAGLGKDVLLLTDGRFSGGTTGFCVGHIAPEAVDAGPIAFVRDGDRIRLDVAGRTLDVLTDPPEFAARQQNFTPPAPRYKTGVLAKYVKLVGSAAIGAVCG

SEQ ID NO: 15 - DNA, 1728 bp, Mycobacterium avium
atgcccaccaccgattcggcgcgcgccgccgacatcaagcagcccgacatcaagccgcgcagtcgtgacgtcaccgacggcctggagaaggccgccgcccgggggatgctgcgggcggtaggcatgggcgacgaggacttcgccaagccgcagatcggggtggcgtcgtcctggaacgagatcacgccgtgcaacctgtcgctggaccggctggccaaggcggtcaaggaaggcgtcttcgccgcgggcggctacccgctggagttcggcaccatctcggtgtccgacggcatctcgatgggccacgagggcatgcacttctcgctggtgagccgcgaggtgatcgccgacagcgtcgagacggtgatgcaggccgagcgcctggacggctcggtgctgctggccggctgcgacaagtcgctgcccggcatgctgatggccgcggcccgcctggacctggcctcggtgttcctctacgccggctcgatcctgcccggggtggccaagctgtccgacggcagcgagcgcgaggtgacgatcatcgacgcgttcgaggccgtcggcgcgtgcgcgcgcgggctgatgccgcgcgaggacgtcgacgccatcgagcgggccatctgtcccggcgagggcgcctgcggcggcatgtacacggccaacaccatggccagcgccgccgaggcgctggggatgtcgctgccgggcagcgcggccccgccggccaccgaccgccgccgcgacggcttcgcccggcgcagcggccaggccgtcgtcgagctgctgcgccgcggcatcaccgcccgcgacatcctcaccaaggaggcgttcgagaacgcgatcgcggtggtgatggcgttcggcggctccaccaacgcggtgctgcacctgctggccatcgcccacgaggccgacgtggcgctgtcgctcgacgacttcagccggatcgggtcgaaggtgccgcacctggccgacgtcaagccgttcggccggcacgtgatgaccgacgtcgaccacatcggcggcgtgccggtgatgatgaaggcgctgctggacgccgggctgctgaacggcgactgcctgacggtgaccggtgcgacggtggcgcagaacctggccgcgatcgccccgcccgacccggacggcaaggtgctgcgggcactcagcgatccgttgcacccgaccggcggcatcaccatcctgcgcgggtcgctggcgcccgagggcgcggtggtcaagtccgccggcttcgattccgacgtgttcgaaggcaccgcaagggttttcgacggcgagcgggccgcgctggacgcgctggaggacggcaccatcaccaagggcgacgcggtggtgatccggtacgagggccccaagggcgggcccgggatgcgcgagatgctcgccatcaccggcgcgatcaagggcgccgggctgggtaaggacgtgctgttactcaccgacggccgcttctccggcgggacgacgggactgtgtgtcggccacatcgcgcccgaggcggtggacgcagggccgatcgcctttctgcgcgacggcgaccgcatccgcctggacgtcgccaaccgggttctggacgtactcgtcgatccggccgaattcgactctcggcgaacaggtttcaccccgccgccgccccgctacaagaccggggtgctggccaagtacgtcaagctcgtcggttccgcggcgatcggcgccgtctgcggctag

SEQ ID NO: 16 - protein, 575 aa, Mycobacterium avium
MPTTDSARAADIKQPDIKPRSRDVTDGLEKAAARGMLRAVGMGDEDFAKPQIGVASSWNEITPCNLSLDRLAKAVKEGVFAAGGYPLEFGTISVSDGISMGHEGMHFSLVSREVIADSVETVMQAERLDGSVLLAGCDKSLPGMLMAAARLDLASVFLYAGSILPGVAKLSDGSEREVTIIDAFEAVGACARGLMPREDVDAIERAICPGEGACGGMYTANTMASAAEALGMSLPGSAAPPATDRRRDGFARRSGQAVVELLRRGITARDILTKEAFENAIAVVMAFGGSTNAVLHLLAIAHEADVALSLDDFSRIGSKVPHLADVKPFGRHVMTDVDHIGGVPVMMKALLDAGLLNGDCLTVTGATVAQNLAAIAPPDPDGKVLRALSDPLHPTGGITILRGSLAPEGAVVKSAGFDSDVFEGTARVFDGERAALDALEDGTITKGDAVVIRYEGPKGGPGMREMLAITGAIKGAGLGKDVLLLTDGRFSGGTTGLCVGHIAPEAVDAGPIAFLRDGDRIRLDVANRVLDVLVDPAEFDSRRTGFTPPPPRYKTGVLAKYVKLVGSAAIGAVCG

SEQ ID NO: 17 - DNA, 1728 bp, Mycobacterium tuberculosis
atgccgcaaaccaccgacgaagccgcttccgtctcgacggtcgccgacatcaagccccgcagtcgagacgtcaccgacggcctggagaaggccgctgcccggggcatgttgagggcggtgggcatggacgacgaagacttcgcgaagccacagatcggggtcgcgtcgtcgtggaacgaaatcacgccgtgcaatctctcattggaccggctggccaacgcggtcaaggagggggtgttttcggccggcggctatccgcttgagttcggcacgatctcggtttcggacggcatctccatgggtcatgaggggatgcacttctcgctggtttcccgtgaggtgatcgccgacagcgtcgaagtcgtgatgcaggccgaacgactcgacggttcggtgctgctggccggatgcgacaaatcgctgcccggaatgctgatggccgccgcacgactggatctggcggcggtgttcctctacgcgggctctattttgcccggccgggccaagctctccgacggtagcgaacgagacgtcaccatcattgacgccttcgaggcggtcggagcgtgctctcgcggtttgatgagtcgcgccgacgtcgatgccatcgagcgggcaatctgccccggcgaaggggcatgcggcggcatgtacaccgctaacaccatggccagcgccgccgaggcgctcggcatgtcgttgccgggcagcgcggcaccgccggcgaccgaccgccggcgcgacgggttcgcgcgtcgcagcgggcaggccgtcgtcgagctgctgcgccgcggcatcaccgcccgcgacatcctcaccaaggaggcgttcgagaacgccatcgcggtgggaatggcgttcggcggctcgaccaacgcggtgctgcatctgctggccatcgcccacgaggccaacgtcgcactatcgcttcaggacttcagccggatcgggtcgggggtgccgcatttggccgatgtcaagccgttcggccgccatgtgatgtccgacgtcgatcacatcggcggtgtgccggtggttatgaaggcgctgctggacgccggtctgctacacggcgactgcctgacggttaccggtcacaccatggccgagaatctggctgccatcaccccgccggatccagatggcaaggtgctacgtgcgttggcaaacccgatccacccgagcggtggcatcaccatcctgcacggatcgctggcacccgaaggtgcggtggtcaagaccgccggattcgattccgacgtattcgaaggcaccgcaagagttttcgacggcgagcgcgctgcgctggacgcccttgaggatggcaccattaccgtgggcgacgccgtggtaatccggtacgaaggacccaagggcggccccgggatgcgcgaaatgctcgccatcacaggcgcgatcaaaggcgcaggactcggtaaagatgttctactgctgaccgacggccggttctccggtggaaccaccggcctgtgcgttggccacatcgcaccggaggcggtcgacggcggaccgatcgcacttctgcgcaacggcgaccggatccggctcgacgtggccggccgcgttctcgatgtgttggccgatccggccgaattcgcgtcccgacaacaggatttcagtcctccaccgccgcgctacactactggcgtactgtccaagtacgtcaagctggtcagctctgccgcggtcggcgcggtctgcggctag

SEQ ID NO: 18 - protein, 575 aa, Mycobacterium tuberculosis
MPQTTDEAASVSTVADIKPRSRDVTDGLEKAAARGMLRAVGMDDEDFAKPQIGVASSWNEITPCNLSLDRLANAVKEGVFSAGGYPLEFGTISVSDGISMGHEGMHFSLVSREVIADSVEVVMQAERLDGSVLLAGCDKSLPGMLMAAARLDLAAVFLYAGSILPGRAKLSDGSERDVTIIDAFEAVGACSRGLMSRADVDAIERAICPGEGACGGMYTANTMASAAEALGMSLPGSAAPPATDRRRDGFARRSGQAVVELLRRGITARDILTKEAFENAIAVGMAFGGSTNAVLHLLAIAHEANVALSLQDFSRIGSGVPHLADVKPFGRHVMSDVDHIGGVPVVMKALLDAGLLHGDCLTVTGHTMAENLAAITPPDPDGKVLRALANPIHPSGGITILHGSLAPEGAVVKTAGFDSDVFEGTARVFDGERAALDALEDGTITVGDAVVIRYEGPKGGPGMREMLAITGAIKGAGLGKDVLLLTDGRFSGGTTGLCVGHIAPEAVDGGPIALLRNGDRIRLDVAGRVLDVLADPAEFASRQQDFSPPPPRYTTGVLSKYVKLVSSAAVGAVCG

SEQ ID NO: 19 - DNA, 1695 bp, Mycobacterium lepraea
atgatgccccctgacatcaaaccccgcagccgcgacgttaccgatggcctggagaaggccgctgctcgtggcatgttgcgcgcagtcggcatgaacgatgacgacttcgccaaggcgcagatcggagttgcgtcatcatggaacgagatcacaccttgcaatctctcgctggaccgcctggccaaggcggtcaaggagggggtattctcggccggcggttatccgcttgagttcggaacaatttcggtttccgacggcatctcgatggggcaccaggggatgcacttctcgctggtgtcgcgcgaggttatagcggacagcgtcgaaaccgtaatgcaggccgagcgcctcgacggctcagtgcttttggctggctgcgataaatcactacccggaatgctgatggccgccgcacgtctcgacctcgcgtcggtatttctctacgccggctcgatcttgcccggacgaaccaagctctccgacggcaccgaacacgaagtcacgctcatcgacgcattcgaagcggtcggcgcgtgttctcgcggattaatgccccgcgctgatgtcgacgccatcgagcgggcgatctgccccggcgagggggcatgcggtggcatgtacactgccaacactatggccagcgcagcagaggcgctgggtatgtccttgccgggcagcgctgcgccgccggcaacagaccgtcgccgtgatggcttcgcgcggcgtagcgggcaggccgtcatcgaactgctgcgtcgcggtataaccgctcgcgacatccttaccaaggaagcgtttgagaacgcgatcgcggtggtgatggcgttcggtggctcgaccaacgcgatcctgcatctactggccattgcccatgaggccgacgtcaccttgtcgctcgaggacttcagtcggatcggatttaaggtgccgcatatagccgacgttaagccgttcggccggcacgtgatgttcgacgtcgaccacatcggtggtgtgccggtggtaatgaaagcacttctggacgcaggtctactgcacggtgattgcctgacggtgaccggtcagacgatggccgagaacctagcctccattgccccgccagacccggatggccaggtgatccgcacgttgcataatccaattcatccgacgggaggcattacgatcctgcgtggatcgttggcacctgatggcgcggtggttaagacggctggactcgactccgatgtgttcgaaggaactgcaagggttttcgacggagaacgggccgcgttggacgcactcaaggacggcaccatcgccaaaggcgatgttgtggttatccgctatgaaggcccgaaaggcggcccggggatgcgcgaaatgctagccatcaccggtgccatcaaaggtgccgggctaggcaaagatgttctgctacttactgacggcaggttctctggcggaacgaccggcttttgcgtaggacacatcgcgccggaagctgtcgaagcgggaccaatcgcattcctgcgtgacggcgaccgggtcctgctagacgttgtcggctgctccctcgatgtgctggtcgatccagtcgaattttcctctcggaaaaaggatttcattcctcctgcgccacgctacaccaccggtgtgcttgccaagtacgtcaagctcgtcagttcggcgacggtcggcgcggtctgcggttag

SEQ ID NO: 20 - protein, 564 aa, Mycobacterium lepraea
MMPPDIKPRSRDVTDGLEKAAARGMLRAVGMNDDDFAKAQIGVASSWNEITPCNLSLDRLAKAVKEGVFSAGGYPLEFGTISVSDGISMGHQGMHFSLVSREVIADSVETVMQAERLDGSVLLAGCDKSLPGMLMAAARLDLASVFLYAGSILPGRTKLSDGTEHEVTLIDAFEAVGACSRGLMPRADVDAIERAICPGEGACGGMYTANTMASAAEALGMSLPGSAAPPATDRRRDGFARRSGQAVIELLRRGITARDILTKEAFENAIAVVMAFGGSTNAILHLLAIAHEADVTLSLEDFSRIGFKVPHIADVKPFGRHVMFDVDHIGGVPVVMKALLDAGLLHGDCLTVTGQTMAENLASIAPPDPDGQVIRTLHNPIHPTGGITILRGSLAPDGAVVKTAGLDSDVFEGTARVFDGERAALDALKDGTIAKGDVVVIRYEGPKGGPGMREMLAITGAIKGAGLGKDVLLLTDGRFSGGTTGFCVGHIAPEAVEAGPIAFLRDGDRVLLDVVGCSLDVLVDPVEFSSRKKDFIPPAPRYTTGVLAKYVKLVSSATVGAVCG

SEQ ID NO: 21 - DNA, 1692 bp, Kineococcus radiotolerans
gtgagcgtcgacatcaagccccgcagtcgccaggtcaccgacggtctggaggcgaccgcctcgcgcggcatgctccgcgccgtcggcatgggcgacgacgactgggagaagccccagatcggggtggcctccagctggaacgagatcaccccctgcaacctgtccctggaccgcctcgcgaaggccgtcaaggacggcgtgcactccgcccacggcttcccgatggagttcggcaccatctccgtctccgacggcatctcgatgggccacgaggggatgcactactccctcgtctcgcgcgaggtcatcgccgactccgtcgagaccgtcatgagcgccgagcgcctcgacgggtccgtcctgctcgccggctgcgacaagtccctgccggggatgctcatggccgccgcgcgcctggacctggccagcgtcttcctctacgccggcacgatcctgcccgggcgggccaagctgtccgacggcagcgagcacgaggtcaccctcatcgacgccttcgaggccgtcggggcgtgcgcgcgggggctgatgtcccgcgaggacgtcgacgtcatcgagcgcgccatctgccccggcgagggggcctgcgggggcatgtacaccgcgaacacgatggccgccgcggccgaggcgctggggatgtccctgcccggcagcgcggccccgcccgcgaccgaccgccgtcgcgacgggttcgcccgccgctccggcgaggccgtggtgaacctgctctcgaagggcatcaccgcccggcagatcctcaccaaggaggcgttcgagaacgccatcgccgtcgtcatggccctgggcggctccaccaacgccgtcctgcacctgctggccatcgcctacgaggccgaggtcgacctcaccctcgccgacttcgaccgcgtcgccgcgaaggtcccgcacctggccgacctcaagcccttcggccgccacgtcatggtcgacgtcgaccgcatcggcggcatccccgtcgtcatgcgcgcgctgctggacgcgggcctgctgcacggggactgcctgacggtgaccgggaggacgatggccgagaacctcgccgacatcgccccgcccgacgtcgacggcgtcgtgctgcgctcgctgcaggaccccatccacaagaccggcggcatcacgatcctctccggcaacctcgcccccggcggcgcggtggtgaagagcgcgggcttcgactccgacgtcttcgagggcaccgcgcgggtcttcgagcgcgagcgcgccgccctggacgccctggaggacggcacgatctccgccggcgacgtcgtcgtcatccgctacgagggccccaagggcggcccggggatgcgcgagatgctcgccatcaccggcgcgatcaagggcgcgggcctgggcaaggacgtgctgctcatgaccgacgggcgcttctccggcgggacgacgggcctgtgcgtggggcacgtggcccccgaggccgtcgacgccggtcccatcgcgttcgtgcgcgacggggaccggatccgcctggacgtcgccggcaagaccctcgaggtgctggtggacgaggaggagctcgccgcccgccgcgagggctgggagccgctgcccccggtcttcaagcgcggggtgctggccaagtacgccaagcaggtccagtccgcctcgctcggggccgtctgccgctga

SEQ ID NO: 22 - protein, 563 aa, Kineococcus radiotolerans
MSVDIKPRSRQVTDGLEATASRGMLRAVGMGDDDWEKPQIGVASSWNEITPCNLSLDRLAKAVKDGVHSAHGFPMEFGTISVSDGISMGHEGMHYSLVSREVIADSVETVMSAERLDGSVLLAGCDKSLPGMLMAAARLDLASVFLYAGTILPGRAKLSDGSEHEVTLIDAFEAVGACARGLMSREDVDVIERAICPGEGACGGMYTANTMAAAAEALGMSLPGSAAPPATDRRRDGFARRSGEAVVNLLSKGITARQILTKEAFENAIAVVMALGGSTNAVLHLLAIAYEAEVDLTLADFDRVAAKVPHLADLKPFGRHVMVDVDRIGGIPVVMRALLDAGLLHGDCLTVTGRTMAENLADIAPPDVDGVVLRSLQDPIHKTGGITILSGNLAPGGAVVKSAGFDSDVFEGTARVFERERAALDALEDGTISAGDVVVIRYEGPKGGPGMREMLAITGAIKGAGLGKDVLLMTDGRFSGGTTGLCVGHVAPEAVDAGPIAFVRDGDRIRLDVAGKTLEVLVDEEELAARREGWEPLPPVFKRGVLAKYAKQVQSASLGAVCR

SEQ ID NO: 23 - DNA, 1704 bp, Janibacter sp.
atgagcaagcccgacatcgacatcaagccccgtagccgcgacgtcaccgacggtctcgagaagaccgcggcccgaggaatgctccgtgccgtaggcatgggcgacgacgactgggtcaagccacagatcggtgtcgcgagctcctggaacgagatcaccccctgcaacctctctctcgaccgcctgtccaaggcagtcaaggacggcgtccacgctgccggtggctacccgctcgagttcggcacgatctcggtgtccgacggcatctcgatgggccacgagggcatgcacttctcgctcgtgtcgcgcgagatcatcgccgactccgtcgagaccgtcatgagtgccgagcgcctcgacggctcggtcctgctcgccggctgcgacaagtccctcccgggcatgctcatggctgcggcgcgcctcgacctcgcctcggtcttcctgtatgccgggtcgatccttcccgggatcgcgaagctctcggacggcaccgagaaggaggtcacgatcatcgacgccttcgaggccgtcggtgcagccaacgcgggcaagatgtcgctggccgacgtcgacgccatcgagcgcgcgatctgtccgggggagggcgcctgtggcggtttctacacggccaacaccatggctgcggtcgccgagtcgatcggcatgtccatcccgggttcggccgccccgccagccaccgaccgacgccgcgacgtgcacgcccgccgctccggtgaggccgtcgtcgagctcctgcgtcgcggcatcaccgcccgccagatcatgaccaagcccgcgttcgagaacgccatcgccgtcgtcatggccttcggtggctcgaccaacgccgtcctccacctgctcgccatggcccacgaggccgaggtcgacctcaccatcggcgacttccagcgcatcggcaaaaaggtcccgcacctcgccgacgtcaagccgttcggcgccttcgtcatgaaggacatcgaccacatcggtggcatccccgtcgtcatgaagtcgctgctcgaggccgacctcctcgatggcgacgcactcaccgtgaccggcaagaccgtcgccgagaacctcgacgagatcaagccgccgcacatcgacggtcgcgtgatccgcgagttcagcaacccgatccacaagaccgggggcctcaccatcctcaccggctccctcgcgcccgaaggtgcggtcgtgaagtcggccggattcgacaccgaggtcttcgagggcagcgcccgcgtcttcaacggcgagcgtgccgcgatggatgccgtcgagcagggtgccctcaagccccaggacgtcgtcgtcatccgctacgaagggcccaagggtggcccgggaatgcgcgagatgctcgccgtcaccggcgccatcaagggcgcgggtctcggcaaggacgtcctcctcctcaccgacggtcgcttctccggtggcacgaccggcctctgcgtcggacacgtggcccccgaggccgtcgacgagggccccatcgccttcgtccgtgacggagacggcatccgcctcgacgtcgcgaacggcactcttgacctcctcgtcgacgacgccgagctcgagcgccgccgcaccgagggcgtcacccatcccgagcccaagtacacccgcggcgtgctcgcgaagtaccgcaagctcgtcggctcggccagcaagggcgccgtctgcgactga

SEQ ID NO: 24 - protein, 567 aa, Janibacter sp.
MSKPDIDIKPRSRDVTDGLEKTAARGMLRAVGMGDDDWVKPQIGVASSWNEITPCNLSLDRLSKAVKDGVHAAGGYPLEFGTISVSDGISMGHEGMHFSLVSREIIADSVETVMSAERLDGSVLLAGCDKSLPGMLMAAARLDLASVFLYAGSILPGIAKLSDGTEKEVTIIDAFEAVGAANAGKMSLADVDAIERAICPGEGACGGFYTANTMAAVAESIGMSIPGSAAPPATDRRRDVHARRSGEAVVELLRRGITARQIMTKPAFENAIAVVMAFGGSTNAVLHLLAMAHEAEVDLTIGDFQRIGKKVPHLADVKPFGAFVMKDIDHIGGIPVVMKSLLEADLLDGDALTVTGKTVAENLDEIKPPHIDGRVIREFSNPIHKTGGLTILTGSLAPEGAVVKSAGFDTEVFEGSARVFNGERAAMDAVEQGALKPQDVVVIRYEGPKGGPGMREMLAVTGAIKGAGLGKDVLLLTDGRFSGGTTGLCVGHVAPEAVDEGPIAFVRDGDGIRLDVANGTLDLLVDDAELERRRTEGVTHPEPKYTRGVLAKYRKLVGSASKGAVCD

SEQ ID NO: 25 - DNA, 1704 bp, Nocardioides sp.
atgaccgagcccacctcccgccccgacatcaagccccgctcccgcgacgtcaccgacggcctggagaaggccgccgcgcgcggcatgctgcgggcggtaggcatgggcgacgaggacttcgcgaagccgcagatcggcgtgggctcgagctggaacgagatcaccccgtgcaacctgtccctggaccggctcgccaaggccgtgaagaacggcgtgcacgcggccggcggctacccgctggagttcggcaccatctcggtctccgacggcatctccatgggccacgagggcatgcacttctcgctggtctcccgcgaggtgatcgccgactcggtcgagaccgtgatgatggccgagcgcctggacggctcggtgctgctcgccggctgcgacaagtcgctgccgggcatgatgatggccgccgcccgcctcgacctggccagcgtgttcctctacgccggctcgacgatgcccgggcaggtggacggcaacgacgtcacgatcatcgacgcgttcgaggccgtcggggcgtgcctggccggcaagatcagccgcgacgaggtggaccggatcgagcgggccatctgtccgggcgagggcgcctgcggcggcatgtacaccgcgaacacgatggcctccatcgccgaggcgatcggcatgtcgctccccggctcggcggccccgccggcggtcgatcgccgacgcgacggcttcgcgcaccgctcgggggaggccgtggtcaacctgttgcgccagggcatcacggcccgccagatcatgactcgcgcggcgttcgagaacgcgatcacggtcgcgatggcgctcggcggctcgaccaacgccgtgctccacctgctcgcgatggctcgtgaggccgacgtcgacctcaccatcgacgacttcaaccggatcggtgacaaggtgccgcacctcggcgacctcaaaccgttcggcaagtacgtcatgaacgacgtcgacaagatcggcggcatccccgtcgtgatgaaggcactgctcgacgccggtctgatgcacggcgacgcgctcaccgtcaccggcaagaccctggccgagaacctcgccgagctggccccgccggagctcgatgacgaggtgatccgcaagctggaccggccgatccacaagaccggtgggctcacgatcctcaagggctcgctcgctcccgagggcgccgtggtcaagacggccggcttcgacgactccgtgttcaccggcaccgcccgcgtcttcgacggcgagcgggccgcgatggacgccctcgaggccgggcagatccagccccgcgacgtcgtggtgatccgctacgagggcccgaagggtggccccggcatgcgcgagatgctcgcgatcaccggcgcgatcaagggcgccggcctcggcaaggacgtcttgctgatcaccgacggcaggttctccggtggtacgacgggcctgtgcgtgggccacatcgcccccgaggccgtcgacggcggcccgatcgcgttcgtccgcgacggcgaccagatcaccctcgacgtcgccaaccggctgctcgaggtggaggtcgtcggtcccgatgccgaggccgagtgggagcgccgcaaggtcggctgggagccgaatccgcccaagtacacccgcggggtgctcggcaagtacgccaagatcgtccagtccgccgcgcacggcgccatcaccggctga

SEQ ID NO: 26 - protein, 567 aa, Nocardioides sp.
MTEPTSRPDIKPRSRDVTDGLEKAAARGMLRAVGMGDEDFAKPQIGVGSSWNEITPCNLSLDRLAKAVKNGVHAAGGYPLEFGTISVSDGISMGHEGMHFSLVSREVIADSVETVMMAERLDGSVLLAGCDKSLPGMMMAAARLDLASVFLYAGSTMPGQVDGNDVTIIDAFEAVGACLAGKISRDEVDRIERAICPGEGACGGMYTANTMASIAEAIGMSLPGSAAPPAVDRRRDGFAHRSGEAVVNLLRQGITARQIMTRAAFENAITVAMALGGSTNAVLHLLAMAREADVDLTIDDFNRIGDKVPHLGDLKPFGKYVMNDVDKIGGIPVVMKALLDAGLMHGDALTVTGKTLAENLAELAPPELDDEVIRKLDRPIHKTGGLTILKGSLAPEGAVVKTAGFDDSVFTGTARVFDGERAAMDALEAGQIQPRDVVVIRYEGPKGGPGMREMLAITGAIKGAGLGKDVLLITDGRFSGGTTGLCVGHIAPEAVDGGPIAFVRDGDQITLDVANRLLEVEVVGPDAEAEWERRKVGWEPNPPKYTRGVLGKYAKIVQSAAHGAITG

SEQ ID NO: 27 - DNA, 1722 bp, Renibacterium salmoninarum
atgagtgtggaaaccagtagcgaaaccggcaacaaaccagatatcaaaccgagaagccgcattgtcaccgacggaattgccgccgcgcctgctcgaggaatgctccgagccgttggctttggcgacgaggactttgcgaagccgcagattggcgtcgcgagttcgtggaacgaaattaccccctgcaatctctcccttgatcggctggccaaagccgtcaaagagggcgtgcatgccggcggcggcttcccgatgatctttggcacaatttcggtgtccgatggcatttcgatggggcacgaaggtatgcacttctcgcttgtctcccgcgaagtgattgctgactcggtagagactgttatgcaagcagaacgcatcgatggctcggtgctgcttgctggctgcgataagtcattgccgggcatgttgatggccgcagcccggctcaatgtgtccagtgttttcctctacgccggctcaatcatgcccggctgggtcaagcttgaagacggcacagagaaagacgtcacgcttattgacgcctttgaagctgtcggtgcctgcgcagccggcaaaatgtcggtgggggatctagaccgaatcgaacgggcaatttgtccgggcgaaggtgcctgcggtggtatgtacaccgcgaacactatggcctgtattggcgaggccttgggtatgtccttgcctggctcggctgcgccgccaagtgcggaccgccgtcgcgatatgttcgcgcaccgttctggcgaggctgttgttgagttgctccgccggggcattcgctcgcgcgacatcatgaccaaggaagcctttgagaacgcgattgcggtcacgatggcttttggcggctccacgaacgcagtgctgcacctacttgctattgctcgtgaggccgaggttgatctgcagcttgaggacttcaaccgaattggtgacaagatcccgcacctcggcgacctcaagccttttggccgatacgtgatgaacgacgtcgaccgggtgggcggcgtgccggtgataatgcgcgcgctgctcgatgccgggctactgcatggtgatgccttgaccgtgaccggtaagactctggccgaaaatcttgaagcgatcaatccgccagatctggatggcaagattttgcgtgcgttggataatccaatccacaaaactggtgggttgagtgtgctcaagggctcgcttgcacctggcggcgccgtggttaagaccgccgggttcgacgccgaggttttcgaaggcccggctcgggtttttgaacgcgaacaaggcgcactcgaagcgcttaaggctggcgaaatcaaagcgggcgacgtcgtcgtgatccgctatgaaggccctaaaggtgggccgggtatgcgcgaaatgctcgccatcactggcgcgatcaagggcgctggcctgggcaaagacgtgttgttgttgaccgacggtcggttctccggaggtacaacgggtctgtgcatcgggcacgtggcgccggaagctgtcgacgccgggccaatcgcctttgtgcaagacggcgacctaatccgggttgatatccccaacaagagtttcgatctcttggttgacgaagcagagctggaagctcggaaaatcggttgggagccgttgcctgctcgcttcactaaaggcgtgttggctaagtacgctaagcttgtgcactcggcttccgaaggcgcatactgcggctaa

SEQ ID NO: 28 - protein, 573 aa, Renibacterium salmoninarum
MSVETSSETGNKPDIKPRSRIVTDGIAAAPARGMLRAVGFGDEDFAKPQIGVASSWNEITPCNLSLDRLAKAVKEGVHAGGGFPMIFGTISVSDGISMGHEGMHFSLVSREVIADSVETVMQAERIDGSVLLAGCDKSLPGMLMAAARLNVSSVFLYAGSIMPGWVKLEDGTEKDVTLIDAFEAVGACAAGKMSVGDLDRIERAICPGEGACGGMYTANTMACIGEALGMSLPGSAAPPSADRRRDMFAHRSGEAVVELLRRGIRSRDIMTKEAFENAIAVTMAFGGSTNAVLHLLAIAREAEVDLQLEDFNRIGDKIPHLGDLKPFGRYVMNDVDRVGGVPVIMRALLDAGLLHGDALTVTGKTLAENLEAINPPDLDGKILRALDNPIHKTGGLSVLKGSLAPGGAVVKTAGFDAEVFEGPARVFEREQGALEALKAGEIKAGDVVVIRYEGPKGGPGMREMLAITGAIKGAGLGKDVLLLTDGRFSGGTTGLCIGHVAPEAVDAGPIAFVQDGDLIRVDIPNKSFDLLVDEAELEARKIGWEPLPARFTKGVLAKYAKLVHSASEGAYCG

SEQ ID NO: 29 - DNA, 1767 bp, Arthrobacter aurescens
gtgcaacagcgtcggcagtcgcccggtagacatagactttggaccatgagtgacaccacccagattgcgacagacagcacgccggacattaaaccccgcagccgggtggtgacagacggcattcacgcggcgcctgcccgcggcatgttccgtgcggtgggcatgggcgacgacgactttgccaaaccccaaatcggtgttgccagctcgtggaatgaaattaccccttgcaatctttccctgaatcgcctcgcacaaggcgccaaggaaggcgtccatgccggcggcggcttcccgatgcagttcggcacgatctccgtttcggatggtatttccatgggccacgagggcatgcacttctccctggtctcccgcgaagtcatcgccgactctgtggaaacagtgatgcaggccgagcgcattgacggctcggtgctcctggccggctgtgacaagtcccttccgggcatgctcatggctgctgcccgcttggacctcgcatccgtcttcctctacgccggctccatcatgccgggctgggtcaagctggaggacggctcggagaaggaagtcaccctcattgatgccttcgaggccgtgggtgcctgcgccgccggcaaaatgagcatggaagacctcacaaggatcgaaaaggccatctgtcccggcgaaggcgcctgcggcggtatgtacacggccaacaccatggcgtgcatcggcgaggccttgggcatgtccctcccgggttcagccgccccgccgtcggcagaccgccgtcgtgatgatttcgcacgcaagtccggcgaagccgtagtaaacctgctgcgcctgggcatcacggcccgcgacatcatgaccaaaaaggcgttcgagaatgccattgccgtcaccatggccttcggcggttccaccaacgccgtgctgcacttgctcgcgatcgcccgggaagccgaagtagagctgacgctggacgacttcaatcgcatcggcgacaaaattccgcaccttggggacctcaagcccttcggccgttatgtgatgaccgacgttgacaagatcggcggcgtgccggtcatcatgaaggcactgctcgacgccggactactgcacggcgactgcctcaccgttaccggcaagacgctcgcggaaaacctcgcctcgatcaacccgccggaccttgacggcaaaatcctccgtgcgctggacaacccgatccacaagaccggtggcatcaccatcctccacggctctatggctccggaaggagcggtagtgaagagtgccggttttgatgctgacgtctttgaaggaactgcacgcgttttcgaacgcgagcagggcgccctcagcgcgttggacaacggcgaaatcaacaagggagacgtagtggtcatccgctatgaaggccccaagggcggtcccggcatgcgggaaatgttggccatcaccggcgccatcaagggagcgggactcggcaaggatgtcctccttctcacggatggccggttctcgggtggcacaacgggtctgtgcatcggccacgttgcgcctgaagccgtggatggtggccccatcgcgttcgtgaaggacggtgaccgcatccgtgtagacatcgccgctcgctccttcgacctcctggtggacgaagccgagctcgaagcccgcaaagagggctggaagccactgcccgccaagttcaccaagggtgttcttgccaagtacgccaagcttgtccacagcgcctccaccggagcgtactgcggataa

SEQ ID NO: 30 - protein, 588 aa, Arthrobacter aurescens
MQQRRQSPGRHRLWTMSDTTQIATDSTPDIKPRSRVVTDGIHAAPARGMFRAVGMGDDDFAKPQIGVASSWNEITPCNLSLNRLAQGAKEGVHAGGGFPMQFGTISVSDGISMGHEGMHFSLVSREVIADSVETVMQAERIDGSVLLAGCDKSLPGMLMAAARLDLASVFLYAGSIMPGWVKLEDGSEKEVTLIDAFEAVGACAAGKMSMEDLTRIEKAICPGEGACGGMYTANTMACIGEALGMSLPGSAAPPSADRRRDDFARKSGEAVVNLLRLGITARDIMTKKAFENAIAVTMAFGGSTNAVLHLLAIAREAEVELTLDDFNRIGDKIPHLGDLKPFGRYVMTDVDKIGGVPVIMKALLDAGLLHGDCLTVTGKTLAENLASINPPDLDGKILRALDNPIHKTGGITILHGSMAPEGAVVKSAGFDADVFEGTARVFEREQGALSALDNGEINKGDVVVIRYEGPKGGPGMREMLAITGAIKGAGLGKDVLLLTDGRFSGGTTGLCIGHVAPEAVDGGPIAFVKDGDRIRVDIAARSFDLLVDEAELEARKEGWKPLPAKFTKGVLAKYAKLVHSASTGAYCG

SEQ ID NO: 31 - DNA, 1695 bp, Leifsonia xyli
atgcctcagatcgattggaaaccgcgttcgcgcgttgtcacggacgggatcgaagccaccacgagccgcgggatgctccgtgcggtcggcatgggggacgccgactgggagaagccgcagatcggcatcgcctcgtcctggaacgagatcacgccgtgcaacctctcgctcgaccggctggcccagggcgccaaagaaggcgtccactccggtggcggttatccgctgcaattcggtaccgtctcggtctccgacggtatctcgatggggcacgagggaatgcacttctcgctcgtctcccgtgaggtcatcgccgactcggtcgagacggtcatgatggccgagcggctcgacggcaccgtcctcctcgccggctgcgacaaatcgctgccgggcatgctgatggccgcggcccgtctcgacctctccgcgatcttcctctacgcgggctccatcgcgcccggctgggtcaaactcagcgacggcaccgagaaggacgtcacgatcatcgactcgttcgaggctgtcggtgcgtgcaaggccggcaagatgagcgaggaggacctcaaacgcatcgagtgcgccatagccccgggtgaaggagcctgcggcggcatgtacaccgcgaacaccatggcgtccgtcgccgaggcactcgggatgagcctgcccggctcggctgcgccgccctcggccgaccggcggcgcgactccttcgcccaccgctccggcgaggctgttgtctccctgctgaagcagggcatcacggctcgcgacatcctcaccaagaaggcgttcgagaacgccatcgcggtggcgatggccttcggcgggtcgacgaacgtcgtgcttcacctgctcgccatcgcgcgcgaggccgaggttgacctcaccatcgacgatttcaaccgcatcggcgagacggttccgcacatcggcgatctcaaaccgttcggcacgtacgtcatgaacgacgtcgaccgtcacggtggtgtcccggtcgtcatgaaggcgctcctggacgcgggcctgctgcacggggactgcctcaccgtgaccggcaagaccgtcgcggagaacctggcggagatcgacccgcccgcaccggacggcaccgtcctgcgctcgctggacaaccccatccacccgacaggggggctcacaatcctcaagggcacgctcgctccggagggcgccgttgtcaagacggctggtttcgacgccgaggtgttcgagggcccagcgcgcgtgttcgagcgcgagcgcgccgctatggacgctctcaccgcgggccggatcaacgccggcgatgtggtcgtcatctgctacgaagggccgaagggcggtcccgggatgcgcgagatgctcgcgatcaccgccaccatcaagggtgcaggcctcggcaaggatgtactactcttgacggacgggcgattctcaggcggcacaaccggcctgtgcatcggccacatagcacccgaagcggtggacgctggtcccatcgcattcgtgcgcgatggtgatttgatacgggtcgatatcgcggctcgctccctcgacctactggtcgacgagtcagagctgaccgcccgccgggacggctgggcgcctcttcctccgcgctatacccgtggcgttctcgcgaagtactccaagctcgttcgctccgctgcggagggtgcggtcaccgggtag

SEQ ID NO: 32 - protein, 564 aa, Leifsonia xyli
MPQIDWKPRSRVVTDGIEATTSRGMLRAVGMGDADWEKPQIGIASSWNEITPCNLSLDRLAQGAKEGVHSGGGYPLQFGTVSVSDGISMGHEGMHFSLVSREVIADSVETVMMAERLDGTVLLAGCDKSLPGMLMAAARLDLSAIFLYAGSIAPGWVKLSDGTEKDVTIIDSFEAVGACKAGKMSEEDLKRIECAIAPGEGACGGMYTANTMASVAEALGMSLPGSAAPPSADRRRDSFAHRSGEAVVSLLKQGITARDILTKKAFENAIAVAMAFGGSTNVVLHLLAIAREAEVDLTIDDFNRIGETVPHIGDLKPFGTYVMNDVDRHGGVPVVMKALLDAGLLHGDCLTVTGKTVAENLAEIDPPAPDGTVLRSLDNPIHPTGGLTILKGTLAPEGAVVKTAGFDAEVFEGPARVFERERAAMDALTAGRINAGDVVVICYEGPKGGPGMREMLAITATIKGAGLGKDVLLLTDGRFSGGTTGLCIGHIAPEAVDAGPIAFVRDGDLIRVDIAARSLDLLVDESELTARRDGWAPLPPRYTRGVLAKYSKLVRSAAEGAVTG

SEQ ID NO: 33 - DNA, 1704 bp, Marine actinobacterium
atgtctgagagtgattcgattgatatcaagccacgttcccgcacggtaaccgacggaattgaagcaacaacttcgcgcggaatgctgcgtgcagttggtatgggagatgccgactgggagaagccccagatcggtattgcgagctcgtggaacgagatcaccccctgcaatctgtcgctcgatcgcctcgctcaagcggcgaaagagggagtgcacgccggtggcgggtacccactgcagtttggaacgattagcgtttccgatggcatttcaatggggcacgaggggatgcacttctcactcgtgagtcgcgaagttatcgctgactccgttgaggttgtcatggaggcagagcgcctcgacggttcggtcacgctcgcgggctgcgacaagtcgcttcccggaatgctgatggctgcggcgcggctcaacctcgcctctgtcttcctctatgccggttcgatcgctcccggctgggtcaagctcagcgacggtaccgaaaaagacatcacgatcatcgactcgttcgaagcagtcggcgcagtcaaagctggccggatgagcgaagccgacgccaagcgcatcgagtgtgcttttgcgcccggcgagggtgcctgtggcggtatgtacacggccaacacgatggcgagcgttgcggaagccctgggaatgagtcttcccggctcggcgagcccagcatccgccgatcgtcgtcgcgactacttcgcgcaccgttcaggcgaagctgtcgtcaatcttctgcgcctcggtatcacttcgcgcgacatcatgacgaagaaggcttttgagaacgcgatcacggtagcaatggctcttggtggctccacgaacgttgtgctgcacatcctcgccatcgcgagcgaagccgaagttgaactcacgctcgatgacttcaatcgcatcggcgacaaggttccccacttgggcgacctgaagccgttcggccagtacgtcatgaacgatgttgaccgccacggcgggctcccggtgctcatgaaggcgctcatggaggaggggctcattcacggcgatgccctcacagtgacgggcaagactgttgccgaaaacttggccgagatggacatcgatcctctagatggcaaggttcttcgcaagttcgacaaccccatccaccccactgggggtctcacaattcttaagggttctttcgctcccgagggtgcagtcgtgaagacggcaggtttcgacgttgctgagttcgtgggccctgcccgcgtgttcgagcgcgagcgtgaagcactggatgctttgactgccggcacgatcgaggctggttctgttgtcgtcattcgctatgaaggacccaagggtggaccgggcatgcgcgagatgctcgcgatcacggcggccatcaagggcgctggactcggcaaagatgtactactcttaacagacggacgattctcaggcggcacaaccggactgtgtatcggccacatagctcccgaagcagtagacgcaggtcctattgccttcgtgcgcgatggtgatcttatacgggtcgatatcgcagctcgctcgctcgacttacttgtcgactccgctgagctcgaagcccgccgaaaaggctgggcccccctccctccgcgctacacgcgaggtgttctggccaagtattcgaagcttgttcagtccgccgctcgcggcgcggtcaccagttag

SEQ ID NO: 34 - protein, 567 aa, Marine actinobacterium
MSESDSIDIKPRSRTVTDGIEATTSRGMLRAVGMGDADWEKPQIGIASSWNEITPCNLSLDRLAQAAKEGVHAGGGYPLQFGTISVSDGISMGHEGMHFSLVSREVIADSVEVVMEAERLDGSVTLAGCDKSLPGMLMAAARLNLASVFLYAGSIAPGWVKLSDGTEKDITIIDSFEAVGAVKAGRMSEADAKRIECAFAPGEGACGGMYTANTMASVAEALGMSLPGSASPASADRRRDYFAHRSGEAVVNLLRLGITSRDIMTKKAFENAITVAMALGGSTNVVLHILAIASEAEVELTLDDFNRIGDKVPHLGDLKPFGQYVMNDVDRHGGLPVLMKALMEEGLIHGDALTVTGKTVAENLAEMDIDPLDGKVLRKFDNPIHPTGGLTILKGSFAPEGAVVKTAGFDVAEFVGPARVFEREREALDALTAGTIEAGSVVVIRYEGPKGGPGMREMLAITAAIKGAGLGKDVLLLTDGRFSGGTTGLCIGHIAPEAVDAGPIAFVRDGDLIRVDIAARSLDLLVDSAELEARRKGWAPLPPRYTRGVLAKYSKLVQSAARGAVTS

SEQ ID NO: 35 - DNA, 1695 bp, Clavibacter michiganensis
atgcctgagatcgacatgaagccccggagccgcgacgtcaccgacgggatcgaggccaccgcagcacgcggcatgctccgcgccgtcgggatgggcgacgaggactgggcgaagccccagatcggcgtcgcgagctcctggagcgagatcaccccctgcaacctcagcctcgaccgcctcgcgcagggcgccaaggagggcgtgcacgcgggcggcggctacccgctccagttcggcaccatctccgtcagcgacggcatctcgatgggccacgagggcatgcacttctcgctcgtctcgcgcgaggtcatcgccgacagcgtcgagaccgtcatgatggccgagcgcctcgacgggtccgtgctcctcgcgggctgcgacaagtcgctccccggcatgctcatggccgcggcccgcctcgacctctcctcggtgttcctctacgcgggatccatcgcccccggctgggtcaagctctcggacggcaccgagaaggaggtcaccatcatcgacgccttcgaggcggtcggcgcctgcaaggccggcacgatgagccaggaggacctgacccgcatcgagaaggccatctgcccgggcgagggcgcatgcggcggcatgtacacagcgaacaccatggcgagcgtggccgaggccctcggcatgagcctccccggatccgccgccccgccgagcgccgaccgccgccgcgactacttcgcgcaccggtcgggcgaggccgtcgtcaacctcatcgcggagggcatcaccgcgcgcgacatcatgacgaaggaggcgttcgagaacgccatctccgtggtcatggcgttcggcggatccaccaacgcggtcctccacctcctcgccatcgcgcgcgaggccgaggtcgacctgcagctgtccgacttcaaccgcatcgccgaccgcgtgccgcacctcggcgacctcaagccgttcggccgcttcgtcatgaacgacgttgaccgcgtcggcggcgtccccgtcgtcatgaaggccctgctcgacgcgggcctcctgcacggcgacgtcatgaccgtcaccggccgcaccatgcgcgagaacctcgaggcgatggacctcgcggagctcgacggcacggtcatccggaagatggacgacccgatccacgccaccggcggcatcagcgtcctgcacggctccctcgcccccgagggcgcggtcgtgaagacggccggcttcgacctcgacgtgttcgagggccccgcccgcgtcttcgagcgcgagcgcgccgcgatggacgcgctcaccgagggactcatctcgaagggcgacgtcatcgtcatccgctacgagggccccaagggcggccccggcatgcgcgagatgctcgccatcacgggcgccatcaagggagccggcctcggcaaggatgtactactcttgacggacggtcgattctcaggcggcacaaccggactgtgcatcggccacatggctcccgaagcggtggacgcaggtcccgtcgccttcgtgcgcgatggagaccggatccgtgtcgacatcgccgctcgcacgctcgacctactggtcgacgaggccgagctcgccgcccgccgtgaggggtgggcacctctcccgccgcgctacacgcgcggggtcctcgccaagtacgccaagctcgtgcactcggccgccgagggcgcgatcacgggatga

SEQ ID NO: 36 - protein, 564 aa, Clavibacter michiganensis
MPEIDMKPRSRDVTDGIEATAARGMLRAVGMGDEDWAKPQIGVASSWSEITPCNLSLDRLAQGAKEGVHAGGGYPLQFGTISVSDGISMGHEGMHFSLVSREVIADSVETVMMAERLDGSVLLAGCDKSLPGMLMAAARLDLSSVFLYAGSIAPGWVKLSDGTEKEVTIIDAFEAVGACKAGTMSQEDLTRIEKAICPGEGACGGMYTANTMASVAEALGMSLPGSAAPPSADRRRDYFAHRSGEAVVNLIAEGITARDIMTKEAFENAISVVMAFGGSTNAVLHLLAIAREAEVDLQLSDFNRIADRVPHLGDLKPFGRFVMNDVDRVGGVPVVMKALLDAGLLHGDVMTVTGRTMRENLEAMDLAELDGTVIRKMDDPIHATGGISVLHGSLAPEGAVVKTAGFDLDVFEGPARVFERERAAMDALTEGLISKGDVIVIRYEGPKGGPGMREMLAITGAIKGAGLGKDVLLLTDGRFSGGTTGLCIGHMAPEAVDAGPVAFVRDGDRIRVDIAARTLDLLVDEAELAARREGWAPLPPRYTRGVLAKYAKLVHSAAEGAITG

SEQ ID NO: 37 - DNA, 1707 bp, Saccharopolyspora erythraea
gtgagcaccagcactgatggcacaggacagtcggggcgtggtctgaagccccgcagcggtgacgtgaccgaggggatcgaacgtgctgcggcgcgggggatgctccgggcggtcgggatgcaggacgccgacttcgcgaagccccagatcggggtggcgtcctcgtggaacgagatcacgccgtgcaacctgtcgttgcagcggctcgcgcaggcgagcaaggaaggtgtgcacgcggccggcggcttcccgatggagttcgggacgatctcggtctcggacgggatctcgatgggtcacgtcggcatgcactactcgctcgtgtcccgcgaggtcatcgccgactccgtcgagacggtgatggaggcggagcggctcgacgggtccgtgctgctcgccggctgcgacaagagcctgccgggcatgctgatggccgcggcgcgcctggacgtcgcggcggtcttcgtctacgccgggtcgatcctccccgggcgggtcgacgaccgcgaggtcaccatcatcgacgcgttcgaggcggtgggcgcctgcgcccgcggcctgatcagcgaggccgaggtcgaccgcatcgaacgcgccatctgcccgggagagggcgcgtgcggcggcatgtacaccgcgaacaccatggcctgcgcggcagaggcgatgggcatgtcgctgccgggatcggcgagcccgccgtcggtagaccggcggcgcgacgccggagcccgggaggccgggcgcgcggtggtcgggatgatcgagcgcggactgaccgcgcggcagatcctgaccaaggaggcgttcgagaacgccatcgccgttgtgatggcgttcggtggctccaccaatgccgtgctgcacctgttggcgatcgcgcgggaagccgaggtcgacctgacgctcgacgacttcaaccgcatcggtgaccgcgtcccgcacctcgccgacgtcaagcccttcggtcggcacgtgatgaccgcggtggaccggatcggtggcgtgccggtcgtgatgaaggccctgctcgacgccgggttgctgcacggcgactgcatgacggtcaccgggaagacggtggccgagaacctcgccgagctggatccgccggagctcgacggtgaggtcctgcacaagctgtcgaacccgctgcacccgaccggcgggctgacgattctgcgcggatcgctcgccccggaaggtgcggtggtcaagagcgccgggttcgactccgccactttcgaaggcacggcgcgggttttcgacggcgagcagggtgcgatggacgccgtcgaagacggctcgttgaaggccggcgacgtggtggtgatccggtacgaagggccgcgcggtggtccgggtatgcgcgagatgctcgcggtcaccggtgccatcaagggcgcgggcctgggcaaggacgtcctgctgctgacggacggccgtttctccggcggtaccacggggctgtgcatcggtcacgtggctcccgaggcgaccgacggcgggccgatcgcgttcgtgcgcgacggggacccgatccggctcgacctggcgggccggacgctcgacctgctggtggacgaagccgaactcgcgcgccggaaggaaggctgggtgccgcgggagccgaagttccggcagggcgtgctcgggaagtacgcgcggctggtccggtcggcggcggtgggcgcggtctgctcctga

SEQ ID NO: 38 - protein, 568 aa, Saccharopolyspora erythraea
MSTSTDGTGQSGRGLKPRSGDVTEGIERAAARGMLRAVGMQDADFAKPQIGVASSWNEITPCNLSLQRLAQASKEGVHAAGGFPMEFGTISVSDGISMGHVGMHYSLVSREVIADSVETVMEAERLDGSVLLAGCDKSLPGMLMAAARLDVAAVFVYAGSILPGRVDDREVTIIDAFEAVGACARGLISEAEVDRIERAICPGEGACGGMYTANTMACAAEAMGMSLPGSASPPSVDRRRDAGAREAGRAVVGMIERGLTARQILTKEAFENAIAVVMAFGGSTNAVLHLLAIAREAEVDLTLDDFNRIGDRVPHLADVKPFGRHVMTAVDRIGGVPVVMKALLDAGLLHGDCMTVTGKTVAENLAELDPPELDGEVLHKLSNPLHPTGGLTILRGSLAPEGAVVKSAGFDSATFEGTARVFDGEQGAMDAVEDGSLKAGDVVVIRYEGPRGGPGMREMLAVTGAIKGAGLGKDVLLLTDGRFSGGTTGLCIGHVAPEATDGGPIAFVRDGDPIRLDLAGRTLDLLVDEAELARRKEGWVPREPKFRQGVLGKYARLVRSAAVGAVCS

SEQ ID NO: 39 - DNA, 1677 bp, Acidothermus cellulolyticus
atgcgcgctcagcccgatctcaaaccgcgcagccgtgacgtcaccgatgggctggagcgggccgcggcccgcggcatgctccgcgccgtcggaatgaccgatgcggactgggagaaaccccagatcggagtggcgagttcctggaacgagataacgccctgcaacctctccctcgaccggctcgcgcaggcggccaaggagggcgtgcacgccgccggcgggtatccgctggagttcgccaccatctcggtttccgacggcatctccatgggccatgagggaatgcatttctcgctgatttcccgcgaagtcatcgccgattccgtcgaaaccgtcttcatggctgagcgcttcgacggcgccgtcctgcttgccggttgcgacaagtccgaacccggcatgctgatggcggccgcccggcttgacctggcagcggttttcctctatgccggcagcacgttgccggggaaactcggggaccgggacatcaacatcgtcgatgcgttcgaggctgtcggcggttgccttcgcggcctggtgagccgggaagaggtcgacgccatcgaacggaatttctgtccggtcgaaggggcctgcgcgggcatgttcaccgccaacacgatggccagcgcggcggaagcgctcggcatgtcattgcccggttcggcctcgccgcccgcgccggaccgccggcgcgacggtttcgcccgggcctccggggaggcagtcgtcaacctgctccgccgcggcatcaccgcccgggacatcatgacccgggaggcattcgagaacgcgatcgctgtcgtgatggccctgggcggctccaccaacgccgtgctccatctgctcgcgatcgcccgcgaggcgaacgtcgacctcgccatcgacgatttcaaccggatcggggaccgggtcccgcacttggcggatgtcaagccgttcggccggtacgtgatgagtgacgtcgaccgggtcggcggcgtgcccgtggtgatgaaagcgctgctggacgccgggctgctgcacggcgactgcctgacggtgaccggcaagacggtggcggagaacctcgcggacatcaccccgccggaccccgacggcaaggtgattcacgcgctcacccaaccgatccaccgcaccggcgggctggccattctccgcggttcgctcgccccggacggcgcggtggtgaagaccgccgggctggagtcgacgttcttcgaaggcaccgcccgggtgttcgacggcgaggaggcggccatgcgcgccgtgcccgagctgcgtccgggagatgtcgttgtcatccggtacgaggggccgaaaggcggcccagggatgcgggagatgctcgcggtcaccggcgccatcaagggcgcgggcctcggcaaggatgtgctcctcgtcaccgacggccggttctccggcggtaccacgggtttctgtgtcgctcacgttgctccggaggcggtggacgggggaccgatcgcgttcgtccgggacggtgaccgcatccggctggacgcgcaggcccgtaccctcgacctgctggtggacgccgatgagctggccaaacgacgggccgactggcaaccgccgccgccgcggtacaccaccggagtcgcggccaagtacgtcaagctggttggcagcgcctccgagggtgcgatctgtcggtga

SEQ ID NO: 40 - protein, 558 aa, Acidothermus cellulolyticus
MRAQPDLKPRSRDVTDGLERAAARGMLRAVGMTDADWEKPQIGVASSWNEITPCNLSLDRLAQAAKEGVHAAGGYPLEFATISVSDGISMGHEGMHFSLISREVIADSVETVFMAERFDGAVLLAGCDKSEPGMLMAAARLDLAAVFLYAGSTLPGKLGDRDINIVDAFEAVGGCLRGLVSREEVDAIERNFCPVEGACAGMFTANTMASAAEALGMSLPGSASPPAPDRRRDGFARASGEAVVNLLRRGITARDIMTREAFENAIAVVMALGGSTNAVLHLLAIAREANVDLAIDDFNRIGDRVPHLADVKPFGRYVMSDVDRVGGVPVVMKALLDAGLLHGDCLTVTGKTVAENLADITPPDPDGKVIHALTQPIHRTGGLAILRGSLAPDGAVVKTAGLESTFFEGTARVFDGEEAAMRAVPELRPGDVVVIRYEGPKGGPGMREMLAVTGAIKGAGLGKDVLLVTDGRFSGGTTGFCVAHVAPEAVDGGPIAFVRDGDRIRLDAQARTLDLLVDADELAKRRADWQPPPPRYTTGVAAKYVKLVGSASEGAICR

SEQ ID NO: 41 - DNA, 1704 bp, Corynebacterium efficiens
atgaccaacgatcatgacatcgatatcaagccacgttcacgcgatgtgaccgacggcctggaacgcaccgccgcccggggcatgctccgggcagtcggcatgggcgacgacgactgggagaaaccccagatcggtgtggccagctcctggaatgaaatcaccccctgtaatctcacgctgaagaagcttgctggatttgccaaggagggtgtccacgaggcggggggttaccccctggagttcgggaccatctccgtctccgacggtatctccatgggccacgagggcatgcactattccctggtatcccgcgaggtcatcaccgactccgtggaaaccgtcatgagtgccgagcgactggacggttctgttctactcgccggctgtgacaaatccattcccggcatgctcatggccgccgcccggttgaatctgtcctcggtgttcctctacaacggatccaccatgccgggcaccgcgaagatgtccgacggtacggagcgggaggtcaccctcatcgatgccttcgaggccgtcggagcctgtcgtgcgggaaccatgagccgggaggacgtggatgccattgaacgctccgtgtgccccggggagggtgcctgtggcggcatgtacacagccaacaccatggcctcggctgctgaggccatgggcatgtccctgcccggttccgccgctcccccggcgatccaccaggaccgcaccctctatgcccgccgttccggcgaggcggtggtggaactgctgcgcaggggaatccgtgcccgtgacatcatcacacgggaatcactgctcaatgccgtcgccgtggtcatggcgctgggtggctccaccaacgcggttctgcacctcatggccatcgcccacgaggccgaggtggatctcaccttggaggacttcaacgccgtcggcgacaaggtcccccaccttggtgacctcaaacccttcggccggtatgtgatgaacgacgtattcaagatcggcggcatccccgtggtgatgaaagcgcttctcgacgccggcctcatcaacggcgactgcctcaccatcaccggccggaccgttgcggagaacctccagggcatcaacccaccggatcccgacggccagatcctacgggccattgacaacccgatccacaagaccggtgggctgaccatcctgcacggttccctcgcaccgggtggtgccgtggtcaaaaccgctggtttcgacaccgaacgcttcgagggcaccgcccgtgtcttcaaccaggaagcacccgccatggatgcggtgctcaacggtgaactgaaggctggcgacgtggtgatcatccgctacgagggaccgaagggcggccccggcatgcgcgagatgctcgccatcaccggtgccatcaagggtgccggcatcggcaaggaggtgctgctcatcaccgacggtcgtttctccggtgggtccaccggcctgtgcatcgggcatgtggcccccgaggccgtcgacggcggacctatcgccctcgttgaagacggcgatcccatcctggtcgacatcagccaacgacgtatcgatctcctggtagacgaatccattctggaggagcgcaggaaaaccctgcagcatccggagaatccacgtctccacggcgtgctggggaagtacgccaagctggtgcagtcagcctcaatgggcgcggtctgcttctag

SEQ ID NO: 42 - protein, 567 aa, Corynebacterium efficiens
MTNDHDIDIKPRSRDVTDGLERTAARGMLRAVGMGDDDWEKPQIGVASSWNEITPCNLTLKKLAGFAKEGVHEAGGYPLEFGTISVSDGISMGHEGMHYSLVSREVITDSVETVMSAERLDGSVLLAGCDKSIPGMLMAAARLNLSSVFLYNGSTMPGTAKMSDGTEREVTLIDAFEAVGACRAGTMSREDVDAIERSVCPGEGACGGMYTANTMASAAEAMGMSLPGSAAPPAIHQDRTLYARRSGEAVVELLRRGIRARDIITRESLLNAVAVVMALGGSTNAVLHLMAIAHEAEVDLTLEDFNAVGDKVPHLGDLKPFGRYVMNDVFKIGGIPVVMKALLDAGLINGDCLTITGRTVAENLQGINPPDPDGQILRAIDNPIHKTGGLTILHGSLAPGGAVVKTAGFDTERFEGTARVFNQEAPAMDAVLNGELKAGDVVIIRYEGPKGGPGMREMLAITGAIKGAGIGKEVLLITDGRFSGGSTGLCIGHVAPEAVDGGPIALVEDGDPILVDISQRRIDLLVDESILEERRKTLQHPENPRLHGVLGKYAKLVQSASMGAVCF

SEQ ID NO: 43 - DNA, 1713 bp, Brevibacterium linens
atgagcattgatacgaactccaccaaaccggacatcaaaccacgttctcgcgacgtcaccgacggtctcgaagccaccgctgcgcgcggcatgctgcgtgccgtgggaatgggcgatgacgactgggtcaagccgcagatcgccatcgcgacctcgtggaacgagatcaccccgtgcaacatgtccctgcagcgcctcggtgcggccgccaaggaaggcgtgcacgaatcgggcggattccccctggaattcggcaccatctccgtctccgacggcatctccatgggccacgagggcatgcactactcgctggtctcgcgcgaggtcatcaccgactccgttgagaccgtgatgagcgccgaacgactcgacggatcggtcctcatggccggctgcgacaagtcgatcccgggcatgctcatggcatccgcccgcctcggcctctccagcgtattcctctacaacggctcgatcatgccgggtaccgcgaagatggaggacggcaccgagaaggaagtcaccctcatcgacgccttcgaagcagtcggcgcctgccgtgccggaaccatcagccaaaaagacgtcgactccatcgagcgcgccgtctgcccgggtgaaggcgcctgtggtggcatgtacaccgcgaatacgatggcctcggccgccgaggccatgggcatgtccctgccaggctcggccgcacctcctgccatccaccgcgaccgcacgatgttcgcgcgcaaatccggtgatgctgtcgtcaacctgctgcgtcagggaatcacgacgaaggacatcatcacccgcgaatcgctgcacaacgcgatcgccgtggtcatggccttcggcggatcgaccaacgcggttctccacctcctggccatcgcccacgaggccggagtcgaactcgccctcgatgacttcaaccgcatcggcgacaaggtcccgcacctgggcaacgtcaaacccttcggccagtacgtgatgaacgatgtgttcaagatcggcggcgtgccggtgatcatgaaggctctgctcgacaacggaatgctcaacggcgactgcatgaccgtgacgggaaagaccgtggcggagaacctcgagacgatcaacccgccggaccccgacggcaagatcctgcgcgcgctcaacaacccgattcacgccaccggcggcctcaccgtgctcaagggctcgttggctcccgaaggtgcagtcgtgaagtccgccggcttcgatgccgacgtcttcgaaggcaccgctcgcgtgttcaaccaggagaagccggccatggatgccgtcctcaacggtgagctgaagaagggcgatgtcgtcgtcatccgctacgaaggacccaagggcggacccggtatgcgcgagatgctcgccatcaccggtgcgatcaagggcgcgggaatcggcaaggacgtcctgctcatcaccgacggacgcttctccggcggatcgacgggactgtgcatcggtcacgtggcgcccgaggccgtcgacggcggaccgatcgcactcgtcgaggacggcgacaagatcaccgtcgacatcgcggcacggtccatcgacctgcatgttgacgagtcggtgctcgaagagcgtcgcaagacctggacgattcccgagaaccaccgcctcaccggtgtgctcggaaagtacgcgaagctcgtgcagtcggcctccaccggtgccgtctgcttctga

SEQ ID NO: 44 - protein, 570 aa, Brevibacterium linens
MSIDTNSTKPDIKPRSRDVTDGLEATAARGMLRAVGMGDDDWVKPQIAIATSWNEITPCNMSLQRLGAAAKEGVHESGGFPLEFGTISVSDGISMGHEGMHYSLVSREVITDSVETVMSAERLDGSVLMAGCDKSIPGMLMASARLGLSSVFLYNGSIMPGTAKMEDGTEKEVTLIDAFEAVGACRAGTISQKDVDSIERAVCPGEGACGGMYTANTMASAAEAMGMSLPGSAAPPAIHRDRTMFARKSGDAVVNLLRQGITTKDIITRESLHNAIAVVMAFGGSTNAVLHLLAIAHEAGVELALDDFNRIGDKVPHLGNVKPFGQYVMNDVFKIGGVPVIMKALLDNGMLNGDCMTVTGKTVAENLETINPPDPDGKILRALNNPIHATGGLTVLKGSLAPEGAVVKSAGFDADVFEGTARVFNQEKPAMDAVLNGELKKGDVVVIRYEGPKGGPGMREMLAITGAIKGAGIGKDVLLITDGRFSGGSTGLCIGHVAPEAVDGGPIALVEDGDKITVDIAARSIDLHVDESVLEERRKTWTIPENHRLTGVLGKYAKLVQSASTGAVCF

SEQ ID NO: 45 - DNA, 1710 bp, Tropheryma whipplei
gtgtttatgtcgagcgatgcaaatgcctgtgaaatagatataaagccgagaagccgagtcgtaacccatgggatcgaggcgacaacatcgcgtggtatgctgcgcgccgttggaatgggtgatgctgattgggaaaaaccacagattggcattgcatccagttggaataacataactccgtgcaatttgtcacttgacagacttgcgcagggtgcaagggaaggtgttcacgcagccggtgggtatccgctgcagttttgcactatatcggtttccgacggaatctctatgggtcatgagggaatgcatttttctcttgtttctcgcgaagttattaccgacagcgtggaaaccgttctgatggcagaggcactggatggtgttgttcttcttgctggctgtgataaatccctcccgggtatgcttatggcagctgcaaggcttgatgtgtctgcagtatttctatatgccggcagtattgcccccggttatgtcacactcaagtgtggcgagtcaaaagaagttacaataattgattcattcgaagccgttggtgcctataaggcagggcttattgatcaggatgatcttggccggattgaaagggccatatgccccggggagggcgcatgtggcggcatgtatacggcaaacacaatggcatctgttgcagaagcgcttggtatgagtcttttgggttcggcaagtccaccctcggcagatcgtcgtcgtgatgtttatgcacataagtcgggcgaggcggttgttgagctcctgaagcggggtataaccgcaagagatattttgacaaaagaggcatttgaaaatgcgatagcagttgttatggcccttggcggatctacaaacgccgttttgcatttacttgcgatagctcatgaggcccatgtgccactgacgatagacgattttaacaaaatcgggaatagggttcctcatattgcagacctcaagccttttgggcgctatgtaatgaatgatgtagatcgcgtgggaggtattccagttgttataaatgcattgatgcgggaaggttttatacacggtgatgtaattaccgtttcaggcagaacaatggccgaggagatatctgatatcaatccgggccttcccgacggaaaggttatacactctttttcctcacctctgcacccaacaggcggtataaaggtattaaaaggtacgcttgcaccggatggggccgttgcaaaaacagctggtttcgatactgtggtttttcaaggccccgcaatggtgtttgatcgcgagcgcgcggctatggatgctctcagtgctgggaatataaaaaaggggagcgttattgttattcgctatgaaggcccaaaagggggtccgggtatgcgagagatgctggctattaccgcggcaataaagggaagtggccttggtaaagatgttttattgttgacagacggcaggttctcgggcggtacaaccggtctgtgtatagggcatattgcgccagaggcggttgatcttgggccgattgcgtttgtgcaagatggcgatataatccgcgttgatattgagaaatcgagtattgatgttctggttgatgaaaagcaattgcgcgccaggcacttgactccacccccacccaggtatacaagcggtgttctttcaaaatattcaaaactcgtcaaatctgcttctttgggtgcaataacttag

SEQ ID NO: 46 - protein, 569 aa, Tropheryma whipplei
MFMSSDANACEIDIKPRSRVVTHGIEATTSRGMLRAVGMGDADWEKPQIGIASSWNNITPCNLSLDRLAQGAREGVHAAGGYPLQFCTISVSDGISMGHEGMHFSLVSREVITDSVETVLMAEALDGVVLLAGCDKSLPGMLMAAARLDVSAVFLYAGSIAPGYVTLKCGESKEVTIIDSFEAVGAYKAGLIDQDDLGRIERAICPGEGACGGMYTANTMASVAEALGMSLLGSASPPSADRRRDVYAHKSGEAVVELLKRGITARDILTKEAFENAIAVVMALGGSTNAVLHLLAIAHEAHVPLTIDDFNKIGNRVPHIADLKPFGRYVMNDVDRVGGIPVVINALMREGFIHGDVITVSGRTMAEEISDINPGLPDGKVIHSFSSPLHPTGGIKVLKGTLAPDGAVAKTAGFDTVVFQGPAMVFDRERAAMDALSAGNIKKGSVIVIRYEGPKGGPGMREMLAITAAIKGSGLGKDVLLLTDGRFSGGTTGLCIGHIAPEAVDLGPIAFVQDGDIIRVDIEKSSIDVLVDEKQLRARHLTPPPPRYTSGVLSKYSKLVKSASLGAIT

SEQ ID NO: 47 - DNA, 1731 bp, Methylobacterium extorquens
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaagcccaggccgtgaagaagggtgtcgccgccgccaagggcactccgcgcgagttctgcaccatcaccgtcaccgacggcatcgccatgggccatggcggtatgcgcgcctcgctgccttcccgcgaggtcatcgccgattcggtcgagctgacgatccgcggccattcctacgacgccctcgtggggctggccggctgcgacaagtccctgcccggcatgatgatggccatggtgcgcctcaacgtgccctcgatcttcatctatggcggctcgatcctgccgggctcgttccgcggccggccggttacggtgcaggatctgttcgaggcggtcggcaaggtcgccgtcggcgacatgagcctcgacgacctcgacgagctggagcgggttgcctgcccctcggccggcgcctgcggcgcgcagttcaccgccaacaccatggccaccgtctccgaggcgatcggcctcgcgctgccctactcggccggcgcgcctgccccttacgagatccgcgaccaattctgcgccgccgccggcgagaaggtgatggagctgatcgccaagaacatccgcccgcgcgacatcgtcacccgcaaggcgctggagaacgccgccgcgacggtcgcggcctcgggcggctcgaccaacgcggccctgcacctgccggcgatcgcgcatgaatgcggcatcgagttcaccctgttcgacgtcgccgagatcttccgcaagaccccctacatcgccgacttgaagcccggcgggcgctatgtggccaaggacatgttcgaggtcggcggcatcccgctgctgatgaagacgctgctcgaccacggctacctgcacggcgactgcctcaccgtcaccggccgcaccatcgccgagaacctcgccaaggtcgcctggaacccggatcaggacgtggtgcgcccggccgacaagcccatcaccgtcaccggcggcgtggtgggcctgcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttctccggcgcgacccgcggcttctgcgtcggccatgtcggccccgaggctgccatcggcgggccgatcggcctgctgcgcgacggcgacatcatcaccctcgatgcgatcaagggcacgctcgacgtggcgctctccgacgaggaactggcccagcgtcgcagcgaatggacgccgcggggcaatgccgcgacctccggctacctctggaaatacgcgcagtccgtcgggcctgcagtgaacggggccgtgacgcatccgggcggcgcgggggagacgaacgtctatgccgacatctag

SEQ ID NO: 48 - protein, 576 aa, Methylobacterium extorquens
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWTPRGNAATSGYLWKYAQSVGPAVNGAVTHPGGAGETNVYADI

SEQ ID NO: 49 - DNA, 1734 bp, Methylobacterium nodulans
atggacgcgcgtcacaccatcgacaagtcgaagctgccgagccgctatgtcaccgaggggccggcccgggcgccgcatcgctcgtatctctatgcgatggggctgacgcgggagcagatccaccagccgctggtgggcgtcgcctcctgctggaacgaggccgccccctgcaacatcgcgctcatgcgccaggcgcaggcggtgaagaagggcgtcgccgccgcggccggtaccccgcgggaattctgcaccatcacggtcaccgacggcatcgccatgggccaccggggcatgcgcgcctcgctgccctcccgggaggtcatcgccgattccgtcgagctcaccatgcggggccacgcctacgacgccctggtggggctcgcgggctgcgacaagtccctgcccggcatgatgatggcgatggtgcgcctgaacgtgccgtcgatcttcatctatggcggctcgatcctgcccggctccttccgcgggcggccggtcacggtccaggacctgtttgaggcggtcggcaagcactccgtcggccagatgagcgacgaggatctggacgagctggagcaggtcgcctgcccgtcggccggcgcctgcggggcgcagttcaccgccaacacgatggcgaccgtctccgaggcgatcggcctcgcgctgccctattcggccggcgcgcccgctccctacgagatccgcgacaagttctgcgcggcggccggcgagatggtgatggatctcctcgccaagaacatccgcccgcgcgacatcatcacccgcaaggcgctggagaacgccgccacggtggtcgccgcctccggcggctcgaccaatgcggcgctgcacctgccggccatcgcccacgaggcgggcatcgtcttcgacctgttcgacgtcgccgagatcttccggcgcacgccctacatcgccgacctcaagccgggcgggcgctacgtcgccaaggacctgttcgaggccggcggcatcccgctcctgatgaagaccctgctggaccacggcttcctgcacggcgactgcatcaccgtgaccggccgcaccatcgccgagaacctcgccaaggtggcctggaacccggaccaggacgtcgtgcggccggccgacaccccgatcaccccgaccggtggcgtggtcggcctcaagggcaacctcgcccccgagggcgcgatcgtgaaggtcgccggcatgccggccgaccgccaagtattcgccggcccggcccgcgtcttcgacaacgaggaagcctgtttcgaggcggtgcagaaccgccagtacaaggagggcgacgtcctcgtcatccgctacgagggcccgaagggcggccccggcatgcgcgagatgctggcgaccaccgccgccctctacggccagggcatgggcgacaaggtcgcgctcatcacggacggccgcttctcgggcgcgacccgcggcttctgcgtcggccatgtcgggcccgaggccgcaatcggcggcccgatcggccttctcaaggacggggacatcatccggctcgacgcgatccagggcatcctctcggtcgatctctccgacgaggaactggccgagcgccgcaaggcctggaccccgcgcgcgaacgaggcgacctccggctatctctggaaatacgcgcagaccgtcggcccggcggtgaccggcgccgtgacgcatccgggcggagcccaggagacgctcacctatgcggacatctga

SEQ ID NO: 50 - protein, 577 aa, Methylobacterium nodulans
MDARHTIDKSKLPSRYVTEGPARAPHRSYLYAMGLTREQIHQPLVGVASCWNEAAPCNIALMRQAQAVKKGVAAAAGTPREFCTITVTDGIAMGHRGMRASLPSREVIADSVELTMRGHAYDALVGLAGCDKSLPGMMMAMVRLNVPSIFIYGGSILPGSFRGRPVTVQDLFEAVGKHSVGQMSDEDLDELEQVACPSAGACGAQFTANTMATVSEAIGLALPYSAGAPAPYEIRDKFCAAAGEMVMDLLAKNIRPRDIITRKALENAATVVAASGGSTNAALHLPAIAHEAGIVFDLFDVAEIFRRTPYIADLKPGGRYVAKDLFEAGGIPLLMKTLLDHGFLHGDCITVTGRTIAENLAKVAWNPDQDVVRPADTPITPTGGVVGLKGNLAPEGAIVKVAGMPADRQVFAGPARVFDNEEACFEAVQNRQYKEGDVLVIRYEGPKGGPGMREMLATTAALYGQGMGDKVALITDGRFSGATRGFCVGHVGPEAAIGGPIGLLKDGDIIRLDAIQGILSVDLSDEELAERRKAWTPRANEATSGYLWKYAQTVGPAVTGAVTHPGGAQETLTYADI

SEQ ID NO: 51 - DNA, 1725 bp, Rhodopseudomonas palustris
atggacgcgaaggcgacgctcaagtcgaagctccccagccggcacgtgaccgaagggccggcgcgcgcgccccatcgctcttacctctacgccatgggcctcaccaccgagcagatccaccagccgttcgtcggggtggcgtcgtgctggaacgaggccgcgccctgcaacatttcgctgatgcggcaggctcaggcggtcaagaagggcgtcgcctccgccggcggcaccccgcgcgaattctgcaccatcaccgtgactgacggcatcgccatgggccacgagggcatgcgctcgtcgctgccgtcgcgcgaggtgatcgccgactccgtcgagctgacaatccgcggccactcctatgacgcgctggtcgggctggccggctgcgacaagtctctgcccgggatgatgatggcgatggtccggctcaacgtgccgtcgatcttcatctatggcggctcgatcctgccgggcaccttccggggccagcaggtcaccgttcaggacatgttcgaggcggtcggcaagcactcggtcggcgagatgtcggacgacgacctcgacgaaatcgagcgggtcgcctgtccgtcggccggcgcctgcggcgcgcagttcaccgccaacaccatggcgaccgtgtccgaggcgatcggcctagcgctgccgtattcggccggcgcacctgctccttacgaaatccgcgatgcgttctgcacggcggccggcgagaaggtgatggagctgatcgccgccaacatccggccgcgcgacatcgtcacccgcaaggcgctggagaatgcggccgcggtggtagcagcgtccggcggctcgaccaatgctgcgctgcacctaccagcgatcgcgcatgaatgtggtatcaagttcgatctgtttgatgtcgccgaaatcttcaaaaagacaccatatatcgcggatttgaagccaggcggccgttatgtcgccaaagacatgtatgaagttggcggcataccgctcctgatgaagaccctgctcgatcatggcttcctccacggcgactgcctgaccgtcacgggacggacgatcgccgagaatctgaaagccgtgaagtggaatccgcatcaggacgtggtgcggcaggcgaaccatccgatcaccgtgactgggggcgtcgtcgggctgaagggaaacctcgcaccagaaggtgcgatcgtgaaggtcgcgggaatgtcgaacctgaagttttccgggcctgcccgctgcttcgatcgcgaggaagacgcgttcgaggcggtgcagaagcggacctacaaggaaggcgaggtcctcgtgatccgctacgaggggccgcggggcggccccggaatgcgggaaatgctcgccaccactgcggcgctgaccggccagggcatgggcggcaagatcgcgctgatcaccgacggccggttctccggcgccacccgcggcttctgcatcggccatgtcggcccggaagcggcgctgggtggtccgatcgcgctgctgcgcgacggtgacatcatcgtcatcgacgccgaggccggaacgcttgacgtaaatttgaccgacgacgaactggccgcgcgcaagtccgaatgggcgcatcgcgcgacaaaccacacgtcgggtgcgctttggaaatatgcccagcaggtcgggcccgcagtcagcggcgctgtgactcatccgggcggggcggccgagaagcagtgctatgcggatgtttga

SEQ ID NO: 52 - protein, 574 aa, Rhodopseudomonas palustris
MDAKATLKSKLPSRHVTEGPARAPHRSYLYAMGLTTEQIHQPFVGVASCWNEAAPCNISLMRQAQAVKKGVASAGGTPREFCTITVTDGIAMGHEGMRSSLPSREVIADSVELTIRGHSYDALVGLAGCDKSLPGMMMAMVRLNVPSIFIYGGSILPGTFRGQQVTVQDMFEAVGKHSVGEMSDDDLDEIERVACPSAGACGAQFTANTMATVSEAIGLALPYSAGAPAPYEIRDAFCTAAGEKVMELIAANIRPRDIVTRKALENAAAVVAASGGSTNAALHLPAIAHECGIKFDLFDVAEIFKKTPYIADLKPGGRYVAKDMYEVGGIPLLMKTLLDHGFLHGDCLTVTGRTIAENLKAVKWNPHQDVVRQANHPITVTGGVVGLKGNLAPEGAIVKVAGMSNLKFSGPARCFDREEDAFEAVQKRTYKEGEVLVIRYEGPRGGPGMREMLATTAALTGQGMGGKIALITDGRFSGATRGFCIGHVGPEAALGGPIALLRDGDIIVIDAEAGTLDVNLTDDELAARKSEWAHRATNHTSGALWKYAQQVGPAVSGAVTHPGGAAEKQCYADV

SEQ ID NO: 53 - DNA, 1725 bp, Rhodopseudomonas palustris
gtggacgccaactccaacatcaaggcgaggttgcccagccgtcacgtgacggaaggcccggagcgtgcgccgcaccgctcctacctctatgcgatggggttgaccacgcagcagatccaccagccgttcgtcggcgtggcatcgtgctggaatgaagccgcgccctgcaacatctcgctgatgcgccaggcccaggcggtgaagaagggcgtcgccgccgcgggtggtacgccacgcgaattctgcaccatcaccgtcaccgacggcatcgccatgggccatgacggcatgcgctcgtcgctgccgtcgcgcgaatgcatcgccgactcggtcgagctgaccatccgcggccactcctacgacgcgctggtcgggcttgccggctgcgacaagtcgctgcccggaatgatgatggcgatggtccggctcaacgtgccgtcgatcttcatctatggcggctcgatcctgcccggcaccttccgcggccagcaggtcaccgtgcaggacatgttcgaggcggtcggcaagcattcggtcggcgcgatgtcggacgccgacctcgacgaaatcgaacgggtggcgtgcccctcggccggcgcctgcggcgcccagttcaccgccaacaccatggcgacggtgtcggaggcgatcggcctggcgctgccttattcggccggagcacctgcgccctatgagatccgcgacgccttctgcatgaccgccggcgagcagatcatgacgctgatcgccaagaatatccggccgcgcgacatcgtcaccttgaaggcgctgcagaacgccgcggcggtggtggcggcctccggcggctcgaccaatgcggcgctgcacctgccggcgatcgcgcatgaatgcggcatcaaattcgacctgttcgacgtcgccgaaatcttcaaaaagacaccctatgtcgcggatttgaaacccggcggccgttatgtcgccaaagacatgtacgaagttggtggcataccgcttctgatgaaaacattgctcgatcatggctacctgcacggcgactgcctgacggtcaccggccggacgattgcggaaaatttggcaaccgtgaaatggaatcccgaccaggacgtggtgcgcgcagcggataacccgatcaccgtgaccggtggggtggtcgggctgcaaggcaacctcgcccccgagggggcgatcgtgaaggtcgccgggatgtccaacttgaaattctccggcccggcgcgctgcttcgatcgcgaagaggacgccttcgaggcggtgcagcacaagacctatcgcgaaggcgaagtgatcgtgatccgctacgaagggccgcgcggcggccccggcatgcgcgagatgctgtcgaccaccgcggcgctgaccgggcagggcatgggcggcaagatcgcgctgatcaccgacggccggttctccggcgccacccgcggcttctgcatcggccatgtcggaccggaagccgcgctcggcggcccgatcgcgctgttgcaggacggcgacatcatcgagatcgacgcggtggccggcacgcttaacgtaaaattgaccgaagccgaactctccgcgcgcaagaccaattggcagccgcgtgagaccaaccattcgtcaggcgcgttgtggaagtatgcccaacaggtcggccccgcgctcggtggcgcggtgacccatccgggtggttcgcacgagaaacagtgttatgcggatgtttaa

SEQ ID NO: 54 - protein, 574 aa, Rhodopseudomonas palustris
MDANSNIKARLPSRHVTEGPERAPHRSYLYAMGLTTQQIHQPFVGVASCWNEAAPCNISLMRQAQAVKKGVAAAGGTPREFCTITVTDGIAMGHDGMRSSLPSRECIADSVELTIRGHSYDALVGLAGCDKSLPGMMMAMVRLNVPSIFIYGGSILPGTFRGQQVTVQDMFEAVGKHSVGAMSDADLDEIERVACPSAGACGAQFTANTMATVSEAIGLALPYSAGAPAPYEIRDAFCMTAGEQIMTLIAKNIRPRDIVTLKALQNAAAVVAASGGSTNAALHLPAIAHECGIKFDLFDVAEIFKKTPYVADLKPGGRYVAKDMYEVGGIPLLMKTLLDHGYLHGDCLTVTGRTIAENLATVKWNPDQDVVRAADNPITVTGGVVGLQGNLAPEGAIVKVAGMSNLKFSGPARCFDREEDAFEAVQHKTYREGEVIVIRYEGPRGGPGMREMLSTTAALTGQGMGGKIALITDGRFSGATRGFCIGHVGPEAALGGPIALLQDGDIIEIDAVAGTLNVKLTEAELSARKTNWQPRETNHSSGALWKYAQQVGPALGGAVTHPGGSHEKQCYADV

SEQ ID NO: 55 - DNA, 1725 bp, Bradyrhizobium sp.
atggacgcgaagaccgacatcaagcgcaggctgcccagccgtcatgtgacggaagggccggagcgtgcgcctcatcggtcgtatctctacgcgatgggcctgaccacggcccaaatccatcagcccttcgtcggcgtcgcctcgtgctggaacgaggccgcgccctgcaacatcgcgctgatgcggcaggcgcaagccgtgaagaagggcgtggcccacgccggcggcacgccgcgcgaattctgcaccatcaccgtgaccgacggcatcgccatgggccatgacggcatgcgctcgtcgctgccgtcgcgcgaggcgattgccgattcggtcgagctgacgattcgcggtcatgcctacgacgcgctggttggcctcgccggctgcgataaatcgctgccgggcatgatgatggcgatggtccggctcaacgtgccgtcgatcttcatttatggaggctcgatcctgcccggcaatttccgcggccagcaggtcaccgtgcaggacatgttcgaggcggtcggcaagcattcggtcggcgcgatgtcggatgaggatctcgacgagctcgagcgcgtcgcctgtccgtcggccggtgcgtgcggtgctcagttcacggccaacacgatggcgaccgtctccgaggcgatcggcctggcgctgccgtactcggctggcgcgcccgcaccttacgagatccgcgattccttctgcatgaccgccggcgagaaggtcatggagctgatatcagccaacatccggccgcgcgacatcgtgacgcgagcagcactcgagaatgccgctgcggttgtggcggcctccggcggctcgaccaacgcggccctgcatctaccagcgattgcacacgaggccggcatcaagttcgacttattcgatgtcgccgaaatcttcaaaaagacaccttatatcgcggatttgaagccgggtggccgctatgtcgccaaagacatgttcgaggctggtggcattccgctcttgatgaagacgttgctcgaccatggctatttgaacggcgactgcctcacagtcaccggccggacgatcgccgaaaacctcaaaggcgtgaagtggaatccgcaccaggacgtggtgaggccggccgaccagccgatcactgcaaccggaggtgtcgttggtttgaaaggcaatctcgcgccagagggtgcgatcgtgaaagtcgcgggcatgtcgaacttgaaattcactgggccggcccgctgcttcgatcgggaagaggatgcctttgaagccgttcagaagcggtcctatcgcgagggcgaggtcatcgtcatccgctatgagggcccgcgcggcggtcccggcatgcgggaaatgctgcagaccacggcggcgctgacggggcagggcatgggcggcaagatcgcgctcatcaccgatggccggttctcgggcgcgacgcgcggcttctgcatcggccatatcgggccggaggcggcggtcggcggaccgatcgcgctggtcgaggatggcgacatcatcgagatcgacgccgaggcgggcatcctgaacgtcaagttgagcgatgccgaactgacacaacgcaagaccaagtggacgccgcgtgaaacgcatcacacgtcaggtgcactttggaaatatgcccagcaggtgggacccgccgtggcgggggccgtcacccacccaggtggtgcgcaagagaagtattgctatgcggacatctga

SEQ ID NO: 56 - protein, 574 aa, Bradyrhizobium sp.
MDAKTDIKRRLPSRHVTEGPERAPHRSYLYAMGLTTAQIHQPFVGVASCWNEAAPCNIALMRQAQAVKKGVAHAGGTPREFCTITVTDGIAMGHDGMRSSLPSREAIADSVELTIRGHAYDALVGLAGCDKSLPGMMMAMVRLNVPSIFIYGGSILPGNFRGQQVTVQDMFEAVGKHSVGAMSDEDLDELERVACPSAGACGAQFTANTMATVSEAIGLALPYSAGAPAPYEIRDSFCMTAGEKVMELISANIRPRDIVTRAALENAAAVVAASGGSTNAALHLPAIAHEAGIKFDLFDVAEIFKKTPYIADLKPGGRYVAKDMFEAGGIPLLMKTLLDHGYLNGDCLTVTGRTIAENLKGVKWNPHQDVVRPADQPITATGGVVGLKGNLAPEGAIVKVAGMSNLKFTGPARCFDREEDAFEAVQKRSYREGEVIVIRYEGPRGGPGMREMLQTTAALTGQGMGGKIALITDGRFSGATRGFCIGHIGPEAAVGGPIALVEDGDIIEIDAEAGILNVKLSDAELTQRKTKWTPRETHHTSGALWKYAQQVGPAVAGAVTHPGGAQEKYCYADI

SEQ ID NO: 57 - DNA, 1725 bp, Bradyrhizobium japonicum
atgaacgcaaagaccaacatcaagcagaggctgccgagccgtcacgtgacggaaggccctgcgcgcgcgccccatcgctcctacttctacgccatgggtctgacgacggagcagatccaccagcccttcgtcggcgtcgcctcctgctggaacgaggccgcgccctgcaacatcgctttgatgcgccaggcgcaggcggtgaagaagggcgtcgcgcatgccggcggcacaccccgcgaattctgcaccatcaccgtgaccgacggcatcgccatgggccatgacggcatgcgctcctcgctgccgtcgcgcgaatgcatcgccgattccgtcgagctgaccgtccgcggccatgcctatgacgccctcgtcggccttgccggctgcgacaagtcgctgccgggcatgatgatggcgatggttcgcctcaacgtgccctcgatcttcatctatggcggctcgatcctgcccggcaacttccgcgggcagcaggtcaccgtgcaggacatgttcgaggccgtcggcaagcactcggtcggcgccatgtcggacgaggatctcgacgagatcgagcgcgtggcgtgcccctcggcgggtgcctgcggcgcgcagttcacggccaacaccatggcgaccgtctcggaagccatcggccttgcgctgccttactcggccggtgctccggcaccgtatgaaatccgcgacgccttctgcatgaccgcgggcgagaaggtgatggagctgatcgaccagaacatccggccgcgcgacatcgtcacccgcaaggcgctggagaatgcggccgccgtggtcgcggcctccggcggctcgaccaatgctgcgctgcacctgccggcgatcgcgcacgagtgcggcatcaagtttgacttattcgacgtcgccgaaatcttcaaaaagacaccatatgtcgcggatttgaagccgggcggccgttatgtcgccaaagacatgtttgaagtaggtggcatcccgcttctgatgaagacgctgctcgacaacggatttctccacggcgactgcattacggtcaccggtcgaacgatcgccgaaaacctcaagagcgtgaagtggaatccgcaccaggatgtggtgcacccggcagacaagccgatcaccgtcaccggtggtgtggtgggtctgaagggcaatttggcgccagaaggtgcgatcgtgaaagtcgcgggaatgtccaacctgaggtttaccggtccggcacgctgcttcgaccgggaagaggacgccttcgaggccgtccagaaccgcacataccgcgaaggcgaagtcatcgtgatccgctacgagggccccaagggcggccccggcatgcgggaaatgctccagaccaccgcggcgctgaccgggcagggcatgggcggcaagatcgcgctcatcactgacggccgcttctccggcgccacccgcggcttctgcatcggccatgtcgggccggaagccgccatcggcggcccgatcgggctgctcgaggatggcgacatcatcgagatcgacgcggtcgccggcacccttaacgtaaaattgagcgaccaggagcttgcccagcgcaagaccaaatggagcgctcgcgcgactaaccacacgacgggcgcgctctggaaatatgctcagcaggttggaccagcggtcgggggggcggtcacccatccgggcggtgcgcacgagaaacagtgctatgcggacatctag

SEQ ID NO: 58 - protein, 574 aa, Bradyrhizobium japonicum
MNAKTNIKQRLPSRHVTEGPARAPHRSYFYAMGLTTEQIHQPFVGVASCWNEAAPCNIALMRQAQAVKKGVAHAGGTPREFCTITVTDGIAMGHDGMRSSLPSRECIADSVELTVRGHAYDALVGLAGCDKSLPGMMMAMVRLNVPSIFIYGGSILPGNFRGQQVTVQDMFEAVGKHSVGAMSDEDLDEIERVACPSAGACGAQFTANTMATVSEAIGLALPYSAGAPAPYEIRDAFCMTAGEKVMELIDQNIRPRDIVTRKALENAAAVVAASGGSTNAALHLPAIAHECGIKFDLFDVAEIFKKTPYVADLKPGGRYVAKDMFEVGGIPLLMKTLLDNGFLHGDCITVTGRTIAENLKSVKWNPHQDVVHPADKPITVTGGVVGLKGNLAPEGAIVKVAGMSNLRFTGPARCFDREEDAFEAVQNRTYREGEVIVIRYEGPKGGPGMREMLQTTAALTGQGMGGKIALITDGRFSGATRGFCIGHVGPEAAIGGPIGLLEDGDIIEIDAVAGTLNVKLSDQELAQRKTKWSARATNHTTGALWKYAQQVGPAVGGAVTHPGGAHEKQCYADI

SEQ ID NO: 59 - DNA, 1725 bp, Fulvimarina pelagi
atggacgcacgcgtgatcgacaagacgaaacttccgagccgtcatgtgacggaaggaccgacccgcgcgccgcaccgctcgtatctctatgcgatgggtctctccaaggaagagatccatcagccactggtcggtgttgcctcctgctggaacgaggccgcaccctgcaatatctcgctgatgcgtcaggcgcaggtcgtaaaaaagggcgttgctgccgcacacggaacgccgcgcgaattctgcacgattaccgtcaccgacggtattgccatgggccatcagggcatgaagtcgtcgctggtctcgcgcgatctcatcgccgactcggtcgaactcaccatgcgaggccactcctacgacgcgcttgtcggtcttgccggctgcgacaagtcgctgccaggcatgatgatgtcgatggtacgcctcaacgttccctcggtcttcatctacggtggctcgattctgcccggcaccttcaagggccggcaggtgaccgtgcaggatattttcgaggcggttggccagcattccgtcggcgagatgtcggacgaggatctcgacctgatcgaacaggttgcctgcccctccgccggttcctgcggcgcccagttcacagcgaacaccatggcgacggtcgcagaggcgatcggccttgcgctgccatactcctgcggtgcgccggcgccttacgaaatccgcgaccgcttctgctacgcctcgggcgagatcgtgatggatcttctgcgccgtaacatccgtccgcgcgacatcgtcacccgcaagtcgctggagaatgcggcggccgtcgtcgcggccacgggcggctcgaccaatggcgcgctgcatctgccggcgatcgcccatgagtgtggcatcgagttcgatctcttcgacgtcgccgagatcttccgcaagacgccctacgtcgcggacctcaaaccgggtggcaaatacgtcgccaaggacatgttcgaggccggcggcattccgctcctgatgaagaccatgctggagcacggctatctccacggcgactgcatgacggtcaccggacgcacgatggccgagaacatggagaaggtcgcctggaacgcggatcaggatgtggttcgcccagccaacaatccgatcacgaagaccggcggtgttgtcggcctgaagggcaatctcgcttccgacggtgcgatcgtgaaggtcgcgggcatgaagaacctgaaattctcagggccagcgcgctgtttcgattcggaggaggattgtttcaaagcggtttcggctcgcgactataaggagggcgaggttctcgtcattcgctacgagggtccgaaaggtggccccggcatgcgcgagatgcttcagacgaccgctgcgatctacggccagggaatgggcgacaaggtcgccctcatcactgatggccgcttttccggcgccacccgcggcttctgcatcggccatgttggcccggaagcggcggtcggcggaccgatcggccttttgaaagacggcgacgtgattacgatcgacgcagtcgagggaacgctggacgttgcattgagcgaagatgaactcgccgagcgccgcaaggcttgggagccgcgcgaaaccgactatcagtcgggcgcgctctggaagtatgcccaggtggttggcacggcccgtctcggtgccgtcacccatcccggcggtgcagccgagaggcagtgctatgcggacatctaa

SEQ ID NO: 60 - protein, 574 aa, Fulvimarina pelagi
MDARVIDKTKLPSRHVTEGPTRAPHRSYLYAMGLSKEEIHQPLVGVASCWNEAAPCNISLMRQAQVVKKGVAAAHGTPREFCTITVTDGIAMGHQGMKSSLVSRDLIADSVELTMRGHSYDALVGLAGCDKSLPGMMMSMVRLNVPSVFIYGGSILPGTFKGRQVTVQDIFEAVGQHSVGEMSDEDLDLIEQVACPSAGSCGAQFTANTMATVAEAIGLALPYSCGAPAPYEIRDRFCYASGEIVMDLLRRNIRPRDIVTRKSLENAAAVVAATGGSTNGALHLPAIAHECGIEFDLFDVAEIFRKTPYVADLKPGGKYVAKDMFEAGGIPLLMKTMLEHGYLHGDCMTVTGRTMAENMEKVAWNADQDVVRPANNPITKTGGVVGLKGNLASDGAIVKVAGMKNLKFSGPARCFDSEEDCFKAVSARDYKEGEVLVIRYEGPKGGPGMREMLQTTAAIYGQGMGDKVALITDGRFSGATRGFCIGHVGPEAAVGGPIGLLKDGDVITIDAVEGTLDVALSEDELAERRKAWEPRETDYQSGALWKYAQVVGTARLGAVTHPGGAAERQCYADI

SEQ ID NO: 61 - DNA, 1815 bp, Aurantimonas sp.
ttgccgccacaaaacccgctcaccccagaggtgctgatcgggcgcggcgtcgaggcgggccatgaacagcgttgtgtacgagggggaccgatggacgcgcattcgatcgacaagaagaacctgcccagccggcatgtgaccgaggggccgtcgcgcgcgccgcaccgctcgtacctctacgccatgggtctcaccaaggaagagatccatcagccgctggtcggcgtcgcctcctgctggaacgaggccgcgccgtgcaacatctcgctgatgcgccaggcgcaggtcgtcaagaagggcgtcgcggcagcccgcggtacgccgcgcgagttctgcaccatcaccgtcaccgacggcatcgccatgggccatcagggcatgaaggcttcgctcgtctcgcgcgacctcatcgccgattcggtcgaactgaccatgcgcggccacgcctatgacgcgctggtgggtctggcaggttgcgacaagtcgcttccgggcatgatgatggcgatggttcgcctgaacgtgccgtcggtcttcatctatggcgggtcgatcctgccgggcaatttccgcggccagcaggtcaccgttcaggacatcttcgaggcggtcggcaagcattcggtcggcgagatgaacgacgccgatctcgacgagatcgagcaggtcgcctgtccgtcagccggttcctgcggcgcgcagttcaccgccaacaccatggcgaccgtcgccgaggccattggcctggcgctgccctattcctgcggtgcgccggcgccctacgagatccgcgacaagttctgctacgcctcgggcgagatcgtcatggaactcttggcccgcaacatccggccgcgcgacatcgtcacccgcaaggcgttggagaacgccgccgccgtcgtcgcggcgaccggcggatcgaccaatggcgccctgcacctgccggcgatcgcgcatgagtgcggcatcgagttcgacctgttcgacgtcgcggagatcttccgcaagacgccgtacatcgccaacctcaagccgggcggcaaatacgtcgccaaggacatgttcgaggccggcggcatcccgatgctgatgaagaccatgctggaccatggctatctgcacggcgactgcatgaccgtcaccggccgcaccattgccgagaacatggcgaaggtgacctggaacccgaaccaggacgtcatccatccggccaacacgccgatcacccagaccggcggcgtcgtcggcctgaagggtaacctcgcccaggacggcgccatcgtgaaggtcgcgggcatgaagaacctgcggttctccggcccggcgcgctgcttcgattcggaagaggaatgctacgaggccgtctccaagcgccagtacaaggaaggcgaggttctcgtcatccgctacgagggcccgcgcggcggacccggcatgcgcgagatgctgtcgaccacggcggcgctctacggccagggcatgggcgacaaggtcgcgctgatcaccgacggccggttctccggcgcgacccgcggcttctgcatcggccatgtcggtccggaagcggcgctcggcggtccgatcggcctgctgcgcgacggtgacatcatcaccatcgatgccgtcgccgggacactggacgtggacgtctcggatgacgacatgaagaagcgggccgaagactggaagccccgcgaaaccgactaccagtccggtgccatctggaaatacgcccagcaggtcggcacggcgcgcctcggcgcagtgacacatccgggcgcagcggcggaaaagcactgttatgcggacctctag

SEQ ID NO: 62 - protein, 604 aa, Aurantimonas sp.
MPPQNPLTPEVLIGRGVEAGHEQRCVRGGPMDAHSIDKKNLPSRHVTEGPSRAPHRSYLYAMGLTKEEIHQPLVGVASCWNEAAPCNISLMRQAQVVKKGVAAARGTPREFCTITVTDGIAMGHQGMKASLVSRDLIADSVELTMRGHAYDALVGLAGCDKSLPGMMMAMVRLNVPSVFIYGGSILPGNFRGQQVTVQDIFEAVGKHSVGEMNDADLDEIEQVACPSAGSCGAQFTANTMATVAEAIGLALPYSCGAPAPYEIRDKFCYASGEIVMELLARNIRPRDIVTRKALENAAAVVAATGGSTNGALHLPAIAHECGIEFDLFDVAEIFRKTPYIANLKPGGKYVAKDMFEAGGIPMLMKTMLDHGYLHGDCMTVTGRTIAENMAKVTWNPNQDVIHPANTPITQTGGVVGLKGNLAQDGAIVKVAGMKNLRFSGPARCFDSEEECYEAVSKRQYKEGEVLVIRYEGPRGGPGMREMLSTTAALYGQGMGDKVALITDGRFSGATRGFCIGHVGPEAALGGPIGLLRDGDIITIDAVAGTLDVDVSDDDMKKRAEDWKPRETDYQSGAIWKYAQQVGTARLGAVTHPGAAAEKHCYADL

SEQ ID NO: 63 - DNA, 1725 bp, Hoeflea phototrophica
atgagcgtcaaagcattcgacaagtccaagcttccaagccgctacacaacggtcggcccggcgcgggcgccgcacagatcgttcctgtatgctatggggctttcgagcgaggagattgctcagccgctcgttggcgtggcgtcgtgctggaatgaggccgcaccctgcaacatttcgctgatgcgccaggcgcaggtggtgaagaaaggcgtggcttcggcccacggcacaccgcgcgaattctgcaccatcacagtgactgatggcattgcgatgggtcaccagggcatgaaagcttccctggcgagccgcgatctgattgcagattcggtggaattgaccatgcgcggtcactgctacgatgcgatcgtgggtcttgccgggtgcgacaagtcattgccgggcatgatgatgtcgatggtgcgtctgaacgtgccctcgatcttcatctatggcggttctattttgccaggcagcttccgcggccgccagattaccattcaggacgtgttcgaggccgtggggcagcattcggttggcgatatgtcggatgaagacctgctcgaaatcgagcaggttgcctgtccgtcggcgggttcctgcggcgcgcagttcacagccaacacgatggcgactgttgccgaggcgatcggactggcgctgccctattcatgtggcgcgccggcgccttacgagatccgcgaccggttcgcttacgcggccggtgaaaaagtgatggaattgctggccaagcagatccgtccgcgcgacatcgtgacccgcaaggcgctcgaaaacgccgcggccgtcgtcgcggcttcgggcggttcgaccaacgcggcgctgcatctgccagcgattgcgcatgaatgcgggatcgagttcgatctgtttgacgtggctgagatcttcaagaagacgccctacattgccgacctcaagcccggcggcaaatatgtggccaaggacatgttcgaggctggtggcattccgctgttgatgaagaccatgcttgaacatggctatctgcacggcgattgcatgaccgtgacgggccggaccatcgccgagaacatggagaaggtctcctggaacccggagcaggatgtggtgcgcccggcggataagccgatcaccgcgaccggcggtgtggtgggcctcaagggcaatcttgcgaccgacggggcgatcgtgaaagttgccgggatggaacggctgaaattcaccggacccgcacggtgttttgattccgaggaagagtgcttcaatgcggtcacaaatcgcgactataacgaaggcgacgttcttgtgatccgctacgaggggcccaagggcggccccggtatgcgtgagatgctgtcgaccactgcggccatttatggacagggtatgggcgacaaggtggcattgatcacggatggccggttctccggtgcaacgcgcggcttctgcattggccatgtcggcccggaagcggcggaaggcgggccgatcgggctcctggaagatggcgacatcatcgagatcgatgctgttgatggtgttttgagcgtgcagctttccgatgcggaactggctgcgcgcagggaaaagtggacggcgcgcgaaaccgattatgcatcgggcgtgctgtggaaatatgcccagacggtgggggccgcgcgttacggcgccgttacccatccgggcggagcaaaagaaaagcagtgctatgcggatatctga

SEQ ID NO: 64 - protein, 574 aa, Hoeflea phototrophica
MSVKAFDKSKLPSRYTTVGPARAPHRSFLYAMGLSSEEIAQPLVGVASCWNEAAPCNISLMRQAQVVKKGVASAHGTPREFCTITVTDGIAMGHQGMKASLASRDLIADSVELTMRGHCYDAIVGLAGCDKSLPGMMMSMVRLNVPSIFIYGGSILPGSFRGRQITIQDVFEAVGQHSVGDMSDEDLLEIEQVACPSAGSCGAQFTANTMATVAEAIGLALPYSCGAPAPYEIRDRFAYAAGEKVMELLAKQIRPRDIVTRKALENAAAVVAASGGSTNAALHLPAIAHECGIEFDLFDVAEIFKKTPYIADLKPGGKYVAKDMFEAGGIPLLMKTMLEHGYLHGDCMTVTGRTIAENMEKVSWNPEQDVVRPADKPITATGGVVGLKGNLATDGAIVKVAGMERLKFTGPARCFDSEEECFNAVTNRDYNEGDVLVIRYEGPKGGPGMREMLSTTAAIYGQGMGDKVALITDGRFSGATRGFCIGHVGPEAAEGGPIGLLEDGDIIEIDAVDGVLSVQLSDAELAARREKWTARETDYASGVLWKYAQTVGAARYGAVTHPGGAKEKQCYADI

SEQ ID NO: 65 - DNA, 1761 bp, Mesorhizobium loti
atgcggcaggccgcaccgcccgcggcaaggatgagaatggacgccaaggtcatttcaaaggctaagctccctagccgccatgtgactgtcggtccggcgcgtgcgccgcaccggtcctatctctatgccatggggctttccgccgccgagatcgcgcagccgctggtcggcgtcgcctcctgctggaacgaagccgcgccctgcaacatctcgctgatgcgccaggcgcaggtggtcaagaagggtgtcgccgccgccaacggcacaccgcgcgaattctgcaccatcaccgtcaccgacggcatcgccatgggccaccagggcatgaagtcgtcgctggtgtcgcgcgaggtcatcgccgattcggtcgagctcacgatgcgtggccattgctacgatgcgctggtcggcctcgccggctgcgacaagtcgctgcccggcatgatgatggccatggtgcggctcaacgtgccgtcgatcttcatctatggcggttcgatcctgcccggcagctatcgcggccgtcagattaccgtgcaggacgtgttcgaggcggtcggccagcactccgtcggcacgatcggcgacgccgagctgctcgagatcgagcaggcggcctgtccgtcggccggctcctgcggcgcccagttcaccgccaacaccatggcaaccgtcgccgaggcgatcggtctggcgctgccctattcctgcggcgcgccggcgccttacgaaatgcgcgaccgcttcaatttcgcctccggcgaaaagatcatggagctgatcgccaaaaacatccggccgcgcgacatcatcacgctgaaggcgctggagaacgcggcgaccgtggtttccgccaccggcggttcgaccaatgcggcgctgcatctgccggcgatcgcgcatgaggcgggcatcaaattcgatctcttcgatgtcgcaaggattttcgagaagacgccctacatcgccgacctcaagcctggcggcaaatatgtcgcaaaggacatgttcgaggccggcggcattccgctgttgatgaagacgctgctcgaccacggctatctgcatggcgattgcctgacggtgactggccgcactttggccgaaaacatggagcacgttgcctggaatgaacaccaggatgtggtccgcccggccaacagaccaattacccaaaccggcggtgtcgtgggcttgaagggaaaccttgcccccgaaggcgcgatcgtgaaagtcgcgggcatgacggagttgaaattctccggcccggcgcgctgcttcgattcggaagaggaatgtttcgaggcggtgacgcaacgcaactacagggaaggcgaggttctcgtcattcgctacgaagggccgcgcggtggtcccggcatgcgcgagatgctgtcgacgacggcagcgctctacggccagggcatgggcggcaaggtggcgctgatcaccgacggccgcttctcgggcgcgacgcgcggcttctgcatcggccatgtcgggccggaagcggcggtgggcggcccgatcggcctcatccgggatggcgacgtgatttcgatcgacgccgtgaacggcacgatcgaagtggcgctgtcggatagcgaactggcggcgcgggccaagacatggaaggcgcgcacgaccgactatcagtcgggcgcgatatggaaatacgcacagacggtcgggtctgccagggatggcgcggtcacccatccgggtggtgcgaaagaaacacactgctatgcggatatctga

SEQ ID NO: 66 - protein, 586 aa, Mesorhizobium loti
MRQAAPPAARMRMDAKVISKAKLPSRHVTVGPARAPHRSYLYAMGLSAAEIAQPLVGVASCWNEAAPCNISLMRQAQVVKKGVAAANGTPREFCTITVTDGIAMGHQGMKSSLVSREVIADSVELTMRGHCYDALVGLAGCDKSLPGMMMAMVRLNVPSIFIYGGSILPGSYRGRQITVQDVFEAVGQHSVGTIGDAELLEIEQAACPSAGSCGAQFTANTMATVAEAIGLALPYSCGAPAPYEMRDRFNFASGEKIMELIAKNIRPRDIITLKALENAATVVSATGGSTNAALHLPAIAHEAGIKFDLFDVARIFEKTPYIADLKPGGKYVAKDMFEAGGIPLLMKTLLDHGYLHGDCLTVTGRTLAENMEHVAWNEHQDVVRPANRPITQTGGVVGLKGNLAPEGAIVKVAGMTELKFSGPARCFDSEEECFEAVTQRNYREGEVLVIRYEGPRGGPGMREMLSTTAALYGQGMGGKVALITDGRFSGATRGFCIGHVGPEAAVGGPIGLIRDGDVISIDAVNGTIEVALSDSELAARAKTWKARTTDYQSGAIWKYAQTVGSARDGAVTHPGGAKETHCYADI

SEQ ID NO: 67 - DNA, 1728 bp, Mesorhizobium sp.
atgatggacgctcgtgcgatatcgaaggaaaagctgcccagccgctacgttaccgtagggccggcgcgggcgccgcacaggtcttatctttacgcgatggggctctcggcggaagagatcgctcagccgctggtcggcgtggcgacgtgctggaacgaggctgcgccctgcaacatctcgctgatgcgccaggcgcaagtggtgaaaaagggcgtcgcggcagccaaaggcacgccccgcgagttcacaacgattaccgttactgatggcatcgccatgggccaccagggcatgaaggcgtcgctggcctcgcgcgaggtaatcgcggattctgtggaactcaccatgcgcggccattgctatgacgcgcttgtcggccttgcgggttgtgacaaatccctgccggggatgatgatggccatggtgcgcctcaatgtgccgtcggtcttcatctatggcggttcgatcctgcctggcacctggcgcgggcggcagatcaccgttcaagacgttttcgaggcggtcggccagcattcggttggctccatttccgacgacgagctgatggaaatcgagcaagccgcttgtccctcggccggttcctgcggcgctcaattcacggccaacaccatggcgaccgttgccgaggcgattgggctggcgcttccttattcctgcggtgcgcctgcgccttacgagatgcgcgatcgcttcaactatgccgccggcgagaaggtgatggaactggtggccaagcagatacggccgcgtgacatcgtgacccggaaggcgcttgaaaacgccgcggccgtggttgccgcgtcggggggctccaccaatgcggcattgcatttgccggccatcgctcatgaagccggaattgaattcgaccttttcgacgtcgcggaagtgttcaagagaacaccctatgtcgccgatttgaagccgggcggcaaatatgtcgccaaggacatgttcgaggcgggcggcattccgctgctcatgaagaccttgctcgaccatggctatctgcatggcgactgcatgaccgtcaccggccgcacgcttgcggagaacatggaacgcgtcgagtggaacgatgcgcaggacgtggtttatccggctgacaagccgctgagcccgacgggcggcgtcgtgggccttaaaggcaatctcgcgccggatggggcaatcgtgaaggttgcaggcatgaagaacctgcgcttctccggccccgcgcgctgcttcgattcggaagaggaatgcttcgccgcggtttccgagcgccgctataaggaaggcgaggtgctggtgatccgctacgaaggtccgaaaggcgggccgggcatgcgtgaaatgctcgccaccaccgcggccctttacgggcagggcatgggcgacaaggtggcgctgatcacggacgggcggttttcaggcgcgacccgcggcttctgtatcggtcatgtcgggccggaagcagcagtgggcgggccgatagggcttctcaatgacggcgacatcataaccatcgatgcggtggcaggcacgatcgacgtggcgctcggcgaagcggaactggccgaacgccgcgctgcctggaggccgcgcgaaagcgaatatcggtccggcgcgatctggaaatacgcgcagggcgtgggcccggcgcggtatggcgcggtgacgcatcccggcgcccagaaagaaacgcactgctatgcggatatctga

SEQ ID NO: 68 - protein, 575 aa, Mesorhizobium sp.
MMDARAISKEKLPSRYVTVGPARAPHRSYLYAMGLSAEEIAQPLVGVATCWNEAAPCNISLMRQAQVVKKGVAAAKGTPREFTTITVTDGIAMGHQGMKASLASREVIADSVELTMRGHCYDALVGLAGCDKSLPGMMMAMVRLNVPSVFIYGGSILPGTWRGRQITVQDVFEAVGQHSVGSISDDELMEIEQAACPSAGSCGAQFTANTMATVAEAIGLALPYSCGAPAPYEMRDRFNYAAGEKVMELVAKQIRPRDIVTRKALENAAAVVAASGGSTNAALHLPAIAHEAGIEFDLFDVAEVFKRTPYVADLKPGGKYVAKDMFEAGGIPLLMKTLLDHGYLHGDCMTVTGRTLAENMERVEWNDAQDVVYPADKPLSPTGGVVGLKGNLAPDGAIVKVAGMKNLRFSGPARCFDSEEECFAAVSERRYKEGEVLVIRYEGPKGGPGMREMLATTAALYGQGMGDKVALITDGRFSGATRGFCIGHVGPEAAVGGPIGLLNDGDIITIDAVAGTIDVALGEAELAERRAAWRPRESEYRSGAIWKYAQGVGPARYGAVTHPGAQKETHCYADI

SEQ ID NO: 69 - DNA, 1731 bp, Parvibaculum lavamentivorans
atggacgccaagacattcgacaaatcgaaactgccgagccgccacgtcacggtcgggccggagcgcgcgccgcaccggtcctactactatgcgatgggcctcaccgaggaagagatcaatcagcccttcgtcggcgtggcgacctgctggaacgaggcggctccctgcaacatcgcgttgatgcgtcaggcgcagtcggtgaagaagggtgtcaaggccgccgccggcacgccccgcgaattctgcaccatcacggtgacggacggcatcgccatgggccaccagggcatgaaatcctcgctcgccagccgcgacgtgatcgcggattcggtcgagctcaccatgcgcggtcattgctacgacgcgctggtcggccttgccggctgcgacaagtcgctgccgggcatgatgatgtcgatggttcgtctcaacgtcccctccgtcttcatgtatggcggctcgatcctgccgggccatttcaagggcaaggacgtcaccgtggtcgacgtcttcgaggcggtcggccagcactcggcgggcaacatggaagacgaagagctgcatgcgctcgaatgcgtcgcctgtccctccgccggcgcctgcggcggccagttcacggccaacaccatggcctgcgtttcggaagccatgggcctcgcgctgccgggttcggcgggcgcgcctgcgccttatgagagccgcgacgaatatgcggaagcctcgggccgcgccgtcatgcacctcctcgccaacaacatccggccgcgcgacatcgtcacgcgcaaggcgctcgagaatgccgccgtcatcgtcgcggcgacgggcggttcgaccaatggcgggcttcatctcccggccatcgcgcatgaagcgggcatcgatttcgacctgatggaagtcgccgaaatcttcaagaagacgccctacatcaccgacctgaagcccggcggcaattacgtcgcgaaggatcttcacgaggcgggcggcgtttcgatggtcctcaaggtgctgctcgatggcggctatctccacggcgattgcctcaccgtcaccggccagtcgctcgcagacaacctcaaggacgtgaagttcaacccggaccagaaggtcgtctatccgctgtccaatccgctctcgcccaccggcggcgttgtcgggttgcagggctcgctcgcgccggatggcgccatcgtcaaggtcgcgggcatggagaaggatcatctccgtttctccggtccggcgcgttgcttcgacagcgaagaggaatgcttcgaggcggtcgacaaacgtcagtacaaggaaggtgaggttctcgtcatccgctacgagggaccgaagggtggccccggcatgcgcgaaatgctctccaccaccgccgcgctttacggccagggcatgggcgacaaggtcgcgctcatcaccgatggccgcttctccggcggcacgcgcggtttctgcatcggccatgtcggcccggaagccgccgtcggcggccccatcgcgctgatcgaggatggcgacatcatcaccatcgacgcggagaacggcaccatcgatctcgaagtcgacgaagccgtgctcgaaaagcgccgcgcgaactggaagccccgggagaccatgtacgcctccggcgcgctgtggaaatacgcgcagctcgtcggcaccgcccgcaagggcgccgtcacccatccgggcggcaaggcggagaaacatgtctatgcggatatctga

SEQ ID NO: 70 - protein, 576 aa, Parvibaculum lavamentivorans
MDAKTFDKSKLPSRHVTVGPERAPHRSYYYAMGLTEEEINQPFVGVATCWNEAAPCNIALMRQAQSVKKGVKAAAGTPREFCTITVTDGIAMGHQGMKSSLASRDVIADSVELTMRGHCYDALVGLAGCDKSLPGMMMSMVRLNVPSVFMYGGSILPGHFKGKDVTVVDVFEAVGQHSAGNMEDEELHALECVACPSAGACGGQFTANTMACVSEAMGLALPGSAGAPAPYESRDEYAEASGRAVMHLLANNIRPRDIVTRKALENAAVIVAATGGSTNGGLHLPAIAHEAGIDFDLMEVAEIFKKTPYITDLKPGGNYVAKDLHEAGGVSMVLKVLLDGGYLHGDCLTVTGQSLADNLKDVKFNPDQKVVYPLSNPLSPTGGVVGLQGSLAPDGAIVKVAGMEKDHLRFSGPARCFDSEEECFEAVDKRQYKEGEVLVIRYEGPKGGPGMREMLSTTAALYGQGMGDKVALITDGRFSGGTRGFCIGHVGPEAAVGGPIALIEDGDIITIDAENGTIDLEVDEAVLEKRRANWKPRETMYASGALWKYAQLVGTARKGAVTHPGGKAEKHVYADI

SEQ ID NO: 71 - DNA, 1734 bp, Loktanella vestfoldensis
atgcccagcaaccgtgtcgacaaatccaaattgcccagccgccacgtgactgaaggcccgtctcgcgcgccgcaccggtcctatttttatgcgatgggcctggacgaacatgagatcgcacagccttgggtcggtgtcgccacctgctggaacgaagcagccccctgcaacatcacgctgaaccggcaggcccaagccgtcaaggtcggcgtcaagaacgccaaaggcacgccgcgcgaatttaccacaatcaccgtcaccgatggcatcgccatgggccatgaagggatgcggtcgtcactcgcatcacgcgaagcgattgccgataccgttgaactgacgatgcgcggccattgctatgacgcgctggtcggtctggccggttgcgacaaatccttgcccgggatgatgatggcgatggtgcggctgaacgtgccgtcggtgttcatctatggcggctcaatcctgccgggccggttaaacgggcaggacgtgaccgtccaagacgtgttcgaagcggtgggcaagcatcaggccggtaatatgaccgatgcggagctcgaaatccttgaacgcgtcgcctgcccctctgctggggcttgtggtggacaattcaccgccaacaccatggcctgcgtgtccgaagcaatcggtctggcgctgctcaattcctctggcgcgcctgcgccctacgaatcgcgcgatcaatatggtgtcgcttcgggcgaggccgtgatgaacctgatcgccaagaacatccgcgcgcgcgatatcgtcacgcgcaaatcactggaaaacgcggcacggatcgtggcctgcaccggcgggtccaccaatgccggtctgcacctgcctgcgatcgccgccgaggctggcattgattttgatctgtccgatgtctgcgagattttccgcgatacgccctatttcgtcgatctcaaaccgggcggcaaatatgtggccaaggatctttacgaggcaggcggcgtgcctgtcgtgctgaaagaactgcgcaaggccggtctgatccacgaagattgcatgacagcgacaggccgcgtgatcggtgaagaactggacatgatcaagggtgaggcggataaccgcgtcatctattccgtcgccaatccgatcacgaaaaccggcggtgttgtcggcctgaaaggcaaccttgcccccgaaggcgccatcgtcaaggtcgcgggcatgtccgaggaagaacagatatttaccggccctgcccgcgtgttcgaatgcgaagaagacgcgttcgaggccgtaaaagcccgccaatatgaagaaggcgaagtcatcgttatccgcaacgaaggccctgcaggcggccccggtatgcgcgaaatgctgtccaccaccgccgctttgtcgggccaaggcatgggcaaaaaggtcgcgctgatcaccgacggccgcttttcaggtgcgacacgcgggttctgcgtgggtcacgtcggcccagaggccgcgcagggcggccccatcgcgctgttgaaagacggcgacatgatcacgctgaacgcgcgcaccggcgaattgtcggtggcgctgaccgatgcagaactggccgaacggcgcaaaacctgggctggcccgcgcgaaactatctatgcctcgggagccttgtggaaatatgcacagctggtcggatcgacccgtctgggcgcattgacccatccaggtgccaagggcgaaaaacacatctatatggacctgtaa

SEQ ID NO: 72 - protein, 577 aa, Loktanella vestfoldensis
MPSNRVDKSKLPSRHVTEGPSRAPHRSYFYAMGLDEHEIAQPWVGVATCWNEAAPCNITLNRQAQAVKVGVKNAKGTPREFTTITVTDGIAMGHEGMRSSLASREAIADTVELTMRGHCYDALVGLAGCDKSLPGMMMAMVRLNVPSVFIYGGSILPGRLNGQDVTVQDVFEAVGKHQAGNMTDAELEILERVACPSAGACGGQFTANTMACVSEAIGLALLNSSGAPAPYESRDQYGVASGEAVMNLIAKNIRARDIVTRKSLENAARIVACTGGSTNAGLHLPAIAAEAGIDFDLSDVCEIFRDTPYFVDLKPGGKYVAKDLYEAGGVPVVLKELRKAGLIHEDCMTATGRVIGEELDMIKGEADNRVIYSVANPITKTGGVVGLKGNLAPEGAIVKVAGMSEEEQIFTGPARVFECEEDAFEAVKARQYEEGEVIVIRNEGPAGGPGMREMLSTTAALSGQGMGKKVALITDGRFSGATRGFCVGHVGPEAAQGGPIALLKDGDMITLNARTGELSVALTDAELAERRKTWAGPRETIYASGALWKYAQLVGSTRLGALTHPGAKGEKHIYMDL

SEQ ID NO: 73 - DNA, 1734 bp, Roseobacter sp.
atgcccaaagatcaggtcaataagacacacctgcccagccgccatgtgaccgaaggcccatcgcgcgcgccgcaccggtcgtatttttacgccatgggtctggatgaagaagcgatcaagcaaccttgggttggtgtcgcgacctgctggaacgaagcggccccttgcaacatcgccctgaaccgtcaggcgcagtcggtcaagctgggtgtgaaaaaggcgatgggcacgccgcgcgaatttacaacgattactgtcaccgacggcattgcgatggggcatgaagggatgcgctcttcgctggcgtcacgcgaagcaattaccgatacggttgagctgacgatgcgcggccactgctatgatgcgctggtcggtctggccggttgcgacaaatccctgcccggtatgatgatggcgatggtccgtctgaacgtgccgtccgtctttatctatggcgggtccattctgccgggtcgtctggatggcaaggacgtgactgttcaggacgtgttcgaggctgtgggtaaacaccaagcgggcaatatgactgatgcggaactggaagtgctggaacgtgtagcgtgtccatctgctggcgcttgcggtggtcagtttacggccaatacgatggcttgtgtgtccgaagcgattggtctggccctgatgaattcttccggtgcccctgccccttatgaaagccgcgaccagtatggcattgcatcgggtgaagcggtcatgaacctgattgaaaagaacatccgcgcccgtgatgttgtcacccgcaagtcgcttgagaacgccgcgcgcgttgtggcctgtaccggtgggtccaccaatgccggtctacacctgccggccattgcgcatgaggctggcattgatttcgacctttttgatgtctgcgacatcttccgtgatacgccttattttgtcgatctgaaaccgggtggtcaatatgtggccaaagacctttacgaggctggcggcgtacccgtcgtgctgaaagaactgcgcaaggccggtctgatccacgaggagtgcatgacagcatcaggccggaccatgggcgaagagctggatatgatcaaaggcgaggcggacaataaggtgatctattctatcgaaaacccgctgacaccaaccggtggcgttgttggtttgaagggtaatcttgcccccgaaggtgcgattgtgaaggtcgcggggatgaatacgcaagaacagtcttttacaggtcccgcccgttgctttgaaagcgaagaagatgcgtttgaggctgtgaaagcccgccaatacgaagaaggcgaagtgctggtgatccgcaatgaaggccccgccggtggccccggtatgcgcgagatgctggcgacgactgccgcactgtccggccaaggcatgggcaaaaaggtcgcgctgatcacggatggccgcttttctggtgcgacacgcgggttctgtgtgggtcatgtggggccagaggccgcgcacggtggcccgataggcctgttgcagaacggcgatgtcatcacaatcaacgctgtcactggtgaactgtcagtcgatctgagtgacgaagaactggcgacgcgcaaggcgaattggaaaggcccgaaagagacgatctatgcatccggtgctttgtggaaatacgcgcaacttgtgggtggtgcgcgtttgggtgcggtgacgcatccgggtgcgaagtctgaaaaacacatttacatggacctctga

SEQ ID NO: 74 - protein, 577 aa, Roseobacter sp.
MPKDQVNKTHLPSRHVTEGPSRAPHRSYFYAMGLDEEAIKQPWVGVATCWNEAAPCNIALNRQAQSVKLGVKKAMGTPREFTTITVTDGIAMGHEGMRSSLASREAITDTVELTMRGHCYDALVGLAGCDKSLPGMMMAMVRLNVPSVFIYGGSILPGRLDGKDVTVQDVFEAVGKHQAGNMTDAELEVLERVACPSAGACGGQFTANTMACVSEAIGLALMNSSGAPAPYESRDQYGIASGEAVMNLIEKNIRARDVVTRKSLENAARVVACTGGSTNAGLHLPAIAHEAGIDFDLFDVCDIFRDTPYFVDLKPGGQYVAKDLYEAGGVPVVLKELRKAGLIHEECMTASGRTMGEELDMIKGEADNKVIYSIENPLTPTGGVVGLKGNLAPEGAIVKVAGMNTQEQSFTGPARCFESEEDAFEAVKARQYEEGEVLVIRNEGPAGGPGMREMLATTAALSGQGMGKKVALITDGRFSGATRGFCVGHVGPEAAHGGPIGLLQNGDVITINAVTGELSVDLSDEELATRKANWKGPKETIYASGALWKYAQLVGGARLGAVTHPGAKSEKHIYMDL

SEQ ID NO: 75 - DNA, 1734 bp, Dinoroseobacter shibae
atgctcaagcgttcgttcgacaagtccaagctgcccagccgtcacgtcaccgaaggcccttcgcgcgcgccgcatcggtcctattactatgccatgggcatgaccgaggaagagatccaccagccgctggtcggggtcgccacatgctggaacgaggccgcgccctgcaacatcgcgctcagccgccaggcccaggcggtgaagatgggggtcaagcaggcctccggcacgccacgagaattcaccacgatcaccgtgaccgacgggatcgccatgggccacgagggcatgcggtcctcgctggcctcccgcgaggcgattgccgatacggtcgaattgaccatgcgcggccattgctatgacgcgattgtgggtctggcgggctgcgacaagtccctgccggggatgatgatggccatggtgcggctcaacgtgccgtcggttttcatttatggcggctcgatcctgccgggtcggttgaacggcgaggacgtgacggttcaggacgtgttcgaggccgtgggcaagcaccaggccgggaactacaccgatgcagagctggaagtgctggagcgggtggcttgtccgtccgcaggggcctgtggcggtcagttcaccgccaataccatggcctgcgtgtccgaggcgatcggtctggcgctgccgaattccgcgggcgcacccgcgccctacgagagccgcgaccagtatggcgaggcgtcgggccgcgcggtcatggacctgatcgagaaaggcatccgcgcgcgggacatcgtgacccggaagtcgctggagaatgccgcgcggatcgtggcctgcaccggcgggtcgacgaatgccggtctgcacctgcctgcgattgcccatgaggccgggatcgaattcaccttgcaggatgtctgcgacatcttccgagacacgccctatttcgtggacctcaagccgggcggcaaatacgttgccaaggacatgtacgaagcgggcggcgtgcccgtggtgatgcgcgagctgcgccgcgcgggcctgatccacgaggattgcatgaccgtgaccggctattccatcggcgaggagctcgacaaggtcacgctcgaagccgatggccgggtgatctatccggtcgacacgccgctctcgaccacgggcggggttgtcggtctcgagggtaacctggcgcccgaaggtgccatcgtgaagatcgcgggcatgagcgacgaccagttggtcttcaccggcccggcgcgcgtgttcgaatgcgaagaggacgccttcgaggcggttcagaaccgcgcttacgcggaaggcgacgtcttcgtgatccgcaacgagggtcccgcaggcggtcccggcatgcgcgagatgctggccaccacggcggcgctctcgggtcagggcatgggcaagaaggtggcgctgatcaccgatggccggttctccggggccacgcgcggcttctgcgtcggccatgtgggccccgaagcggcccatggcggccccatcgcgatgctcaaggacggcgacatgatcaccatcgacgcgctgaagggcgagctgtccgtcgcgctgagcgaggatgagcttgccgcgcgaaaagatgcctggagcggcccgcgggagacgatctatgcctcgggtgcgttgtggaaatatgcgcagctggttggcggcgcacgcctgggggcagtcacccatcccggagccaaggatgaaaaacacatctacgccgatctctga

SEQ ID NO: 76 - protein, 577 aa, Dinoroseobacter shibae
MLKRSFDKSKLPSRHVTEGPSRAPHRSYYYAMGMTEEEIHQPLVGVATCWNEAAPCNIALSRQAQAVKMGVKQASGTPREFTTITVTDGIAMGHEGMRSSLASREAIADTVELTMRGHCYDAIVGLAGCDKSLPGMMMAMVRLNVPSVFIYGGSILPGRLNGEDVTVQDVFEAVGKHQAGNYTDAELEVLERVACPSAGACGGQFTANTMACVSEAIGLALPNSAGAPAPYESRDQYGEASGRAVMDLIEKGIRARDIVTRKSLENAARIVACTGGSTNAGLHLPAIAHEAGIEFTLQDVCDIFRDTPYFVDLKPGGKYVAKDMYEAGGVPVVMRELRRAGLIHEDCMTVTGYSIGEELDKVTLEADGRVIYPVDTPLSTTGGVVGLEGNLAPEGAIVKIAGMSDDQLVFTGPARVFECEEDAFEAVQNRAYAEGDVFVIRNEGPAGGPGMREMLATTAALSGQGMGKKVALITDGRFSGATRGFCVGHVGPEAAHGGPIAMLKDGDMITIDALKGELSVALSEDELAARKDAWSGPRETIYASGALWKYAQLVGGARLGAVTHPGAKDEKHIYADL

SEQ ID NO: 77 - DNA, 1728 bp, Roseovarius nubinhibens
atgaccaaattcgacaaagcaaaattgcccagccgccatgtgaccgaaggcccggcgcgtgcgccgcaccggtcctacatgtatgcgatggggcttcaggaagaagaaatccatcagcctctggtcggcgtggcgacctgctggaacgaggcggcgccgtgcaacatttcgctcaaccggcaggcgcaatcggtcaagatgggcgtcaaggaagcgggcggcacgccgcgcgagtttaccaccatcaccgtgaccgacggcatcgccatgggccatgagggcatgcgcagctcgctcgcgtcgcgcgaggcgattgccgacactgtcgagctcaccatgcgcggccattgctatgatgcgctcgtcggtctggcgggctgtgacaagtcgctgccggggatgatgatggcgatggtgcggctcaacacgccgtcggtcttcatctatggcggctcgatcatgccgggccggttccagggccgtgacgtgaccgtgcaggacgtgttcgaggccgtcggccgccatcaggcaggggccaattcggacgaagagctgcgggcgctggaaaaggtggcctgcccgtcggccggggcctgtggcggccagttcaccgccaacaccatggcctgtgtctctgaagcgatcggtctggcgctgcccaactcggcgggcgcgcccgcgccctatgaaagccgcgatcaatatggcaccgcctctggtgcggcggtcatgacgcttttggaaaagaacatccgggcgcgcgacatcgtcacgctcaagagccttgagaatgccgcgcgggtcgtggcctgtaccggtgggtcgaccaatgccggtctgcacctgcccgcgattgcgcatgaggcggggctcgagtttttcctcgatgacgtctgccagatcttcaaggacacgccctatttcgtcgatctcaaaccgggcgggcaatatgtcgccaaggacctctatgaggcgggcggcgtgccggtggtgatgaaggagctgcgcaaggcggggctcatccacgaagattgcatgaccgtcaccgggcggaccattggcgaagagatcgacatcgtcgagcgcgaggccgatggccgggtgatctatcccgtcgagaagccgatcaccaagaccggcggcgtcgtgggcctcaagggcaatcttgccccgcagggcgccatcgtgaaggtcgcgggtatgagcgaggaagagcaagtcttctcgggccccgcgcgggtttttgaatgcgaagaggacgcctttgaggcggtcaaggcgcgcagctacaaggagggcgaggttctcgtcatccgcaacgagggccccgcaggcggtccgggcatgcgcgagatgctcgccaccacggcggcgctgtcggggcagggcatgggcaagaaggtcgcgctcatcaccgatggccggttctcgggcgcgacgcgtggcttctgcgtcggccatgtcggaccggaatcggcccatggcggcccgattgccctggtccaggatggcgatgtgatcaccatcaacgcgatcaccggcgagctcagcgtggcgctcagcgatgaggatctgacggcccgcaaggaggcctggaaaggcccgcgcgagacgatctattccagcggcgcgctgtggaaatacgcccagctcgtgggcgagacctacaagggcgctgtgacccaccccggtgccgaagcggagaagcatgtctatatggatctctaa

SEQ ID NO: 78 - protein, 575 aa, Roseovarius nubinhibens
MTKFDKAKLPSRHVTEGPARAPHRSYMYAMGLQEEEIHQPLVGVATCWNEAAPCNISLNRQAQSVKMGVKEAGGTPREFTTITVTDGIAMGHEGMRSSLASREAIADTVELTMRGHCYDALVGLAGCDKSLPGMMMAMVRLNTPSVFIYGGSIMPGRFQGRDVTVQDVFEAVGRHQAGANSDEELRALEKVACPSAGACGGQFTANTMACVSEAIGLALPNSAGAPAPYESRDQYGTASGAAVMTLLEKNIRARDIVTLKSLENAARVVACTGGSTNAGLHLPAIAHEAGLEFFLDDVCQIFKDTPYFVDLKPGGQYVAKDLYEAGGVPVVMKELRKAGLIHEDCMTVTGRTIGEEIDIVEREADGRVIYPVEKPITKTGGVVGLKGNLAPQGAIVKVAGMSEEEQVFSGPARVFECEEDAFEAVKARSYKEGEVLVIRNEGPAGGPGMREMLATTAALSGQGMGKKVALITDGRFSGATRGFCVGHVGPESAHGGPIALVQDGDVITINAITGELSVALSDEDLTARKEAWKGPRETIYSSGALWKYAQLVGETYKGAVTHPGAEAEKHVYMDL

SEQ ID NO: 79 - DNA, 1734 bp, Sagittula stellata
gtgctcaagcgtccgtttgacaagaccaaactgcccagccgtcacgtcactgagggtcccgcccgcgcgccgcatcgctccttcatgtacgccatggggttgagcgaagaagagatccatcagcctcttatcggtgtcgcgacctgctggaacgaggccgcgccctgcaacatctcgctgagccggcaggcgcaggcggtgaagctgggtgtcaaggaagcctccggcacgccgcgcgaattcaccaccatcaccgtgaccgacggcatcgcgatgggccacgaggggatgcgtgcttcgctggcctctcgcgaagccatcgccgatacggtcgagctgacgatgcgcggccactgctacgacgcgcttgtggggcttgcgggctgcgacaagtcactgcccgggatgatgatggcaatggtgcggctcaatgtgccgtcggtcttcatctatggcgggtcgatcatgccgggcaagttccagggccgcgacatcaccgttcaggacgtgttcgaggccgtgggcaagcaccaggcgggcgccaactccgacgaggaactgcgcgccatcgagaaggcggcctgtccctcggccggggcctgcggcggccagttcaccgccaacaccatggcctgcgtgtccgaggccatcggccttgcgttgttgaattcttccggcgcgccagcgccttacgaaagccgcgaccagtacggcaccgcgtccggcatcgccgtgatgaacctgctggagcgcaacatccgcgcccgcgacatcgtcacgatgaagtctctggaaaacgcggcgcgggtggtcgcctgcaccggcggttcgaccaacgccggtctgcacctgcccgccatcgcacatgaggcagggctggaattcttcctagacgacgtgtgcgagatcttccgcgacacaccctatttcgtcgacctgaagcccggcggcaactatgtggccaaggacctttacgaggtcggtggcgttccggttgtgatgaaggagctgcgcgaggcgggcctgatccacgaggactgcatcaccgcatcggggcgatcaatgggagaggaactcgacctgatcgagcgcgaggccgatggcaaagtcatctatcccatagaaacgccgatcaccaagaccggcggcgtcgtgggcctgaagggcaacctcgccccgcagggcgccatcgtgaaggtcgcgggaatcgcggcggaggaccaggtgttcaccggtcccgcgcgtgtcttcgaatgcgaggaagactgctttgaagcggtcaagatgcgcgcctacaaggagggcgaggtgctggtcatccgcaacgagggccccgcaggcggccccggcatgcgcgagatgctggctaccaccgccgccctgtccgggcagggtatgggcaagaaggttgcactgatcaccgacggccgcttttccggtgcgacgcgcggtttctgcgtgggccacgtcggcccagaggcggcgcacggcgggccgatcgcgctggtggaaaccggcgatgtcatcaccatcaacgcacagaccggagagctgtccgtggacctgacggacgagcaactggcggcccgcaaggacgcttggagcgggccgcgggacacgatctatgcctccgggtcgctgtggaaatatgcgcaactcgttggggagacatacaaaggcgccgtcacccatccaggtggcaaggcggagaaacacgtctacgccgatctctga

SEQ ID NO: 80 - protein, 577 aa, Sagittula stellata
MLKRPFDKTKLPSRHVTEGPARAPHRSFMYAMGLSEEEIHQPLIGVATCWNEAAPCNISLSRQAQAVKLGVKEASGTPREFTTITVTDGIAMGHEGMRASLASREAIADTVELTMRGHCYDALVGLAGCDKSLPGMMMAMVRLNVPSVFIYGGSIMPGKFQGRDITVQDVFEAVGKHQAGANSDEELRAIEKAACPSAGACGGQFTANTMACVSEAIGLALLNSSGAPAPYESRDQYGTASGIAVMNLLERNIRARDIVTMKSLENAARVVACTGGSTNAGLHLPAIAHEAGLEFFLDDVCEIFRDTPYFVDLKPGGNYVAKDLYEVGGVPVVMKELREAGLIHEDCITASGRSMGEELDLIEREADGKVIYPIETPITKTGGVVGLKGNLAPQGAIVKVAGIAAEDQVFTGPARVFECEEDCFEAVKMRAYKEGEVLVIRNEGPAGGPGMREMLATTAALSGQGMGKKVALITDGRFSGATRGFCVGHVGPEAAHGGPIALVETGDVITINAQTGELSVDLTDEQLAARKDAWSGPRDTIYASGSLWKYAQLVGETYKGAVTHPGGKAEKHVYADL

SEQ ID NO: 81 - DNA, 1758 bp, Roseobacter sp.
atgaccaaattcgacaaatccaaactgcccagccgttacgtgaccgaaggaccggcccgcgcgccgcatcggtcctattactatgccatgggcatgaccgaggccgagatccatcagccgctggtcggcgtggcgacctgctggaacgaggcggcgccgtgcaacatcgcgctcaaccgtcaggcgcaggccgtcaagggcggcgtcaaggaagcgcatggcagcccgcgtgaattcaccacgatcaccgtgaccgacgggatcgccatgggccatgaaggcatgcgcagctcgcttgccagccgcgaggcgattgccgacactgtcgagctgaccatgcggggccattgctatgacgcgcttgtgggtcttgcgggctgtgacaagtcgctgccgggcatgatgatggcgatggtgcggctcaatgtgccgtcagtgttcatctatggcgggtcgatcctgccgggcaaggcgcctcaggtgaacgaaatccccgaagaattccgcaaccgcgacctgacggtgcaggatatgttcgaagcggtcggctggcaccagaacgagcagatgtccgacaaggcgctcgatatgctcgaacgcgtcgcctgcccctcggcgggcgcttgcggcgggcagttcaccgccaacacaatggcctgcgtctccgaggcgatcggccttgcgctgatgaacagctcgggcatgcccgcgccctacgaatcccgcgaccaatatgccgaggcgtcgggccgcgcggtcatgacccttctggaaaagaacatccgtgcgcgggacgtggtcaccctccaaagcctgcagaacgccgcgcgcgtcgtggcctgcaccggcggctccaccaatgcgggcctgcaccttccggccatcgcccatgaggcggggatcgacttcttcctcgaagatgtctgcgagattttccgcgacacgccctatttcgtcgatctcaagcccggtggtcagtatgtggccaaggatctctatgatgcgggcgggattcccgtcgtgatgaaagagctgcgcaaggcggggctgatccacgaggattgcatcaccgcctcgggccgctccatcggcgaagagcttgacctgatcgaacgcgaggccgatggccgcgtgatctatccgatcgaaaagccgatcaccaagaccggcggtgtcgtcggcctcaagggcaatcttgcgccgcaaggcgccatcgtgaaggtcgcgggcatcgcccccgagcatcaggtcttcaccggcccggcgcgcgtgttcgaatgcgaagaggacgcgttcgaggcggtcaaggcgcgccaatacaaggaaggcgaggtcatcgtgatccgcaacgaaggccccgcaggcggccccggcatgcgcgagatgctgtccacgaccgccgcgctgtccgggcagggcatgggcaagaaggttgcgcttatcaccgatgggcgcttttcgggcgccacacgcgggttctgtgtgggccatgtcggccccgaggcggcgcatggtggcccgatcgccctgatccagaccggcgatgtggtcaccatcgacgcgatcaagggcgaactgagcgtcgatctatcggacgaggagctggccaagcgcaaggaaaactgggccggcccgcgcgagacgatctatgccaccggtgcgatctggaaattcgccaagcttgtgggcgagacctacaagggggctgtcacccatcccggcggcaaggccgagcggcatgtctacatggacctctga

SEQ ID NO: 82 - protein, 585 aa, Roseobacter sp.
MTKFDKSKLPSRYVTEGPARAPHRSYYYAMGMTEAEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVNEIPEEFRNRDLTVQDMFEAVGWHQNEQMSDKALDMLERVACPSAGACGGQFTANTMACVSEAIGLALMNSSGMPAPYESRDQYAEASGRAVMTLLEKNIRARDVVTLQSLQNAARVVACTGGSTNAGLHLPAIAHEAGIDFFLEDVCEIFRDTPYFVDLKPGGQYVAKDLYDAGGIPVVMKELRKAGLIHEDCITASGRSIGEELDLIEREADGRVIYPIEKPITKTGGVVGLKGNLAPQGAIVKVAGIAPEHQVFTGPARVFECEEDAFEAVKARQYKEGEVIVIRNEGPAGGPGMREMLSTTAALSGQGMGKKVALITDGRFSGATRGFCVGHVGPEAAHGGPIALIQTGDVVTIDAIKGELSVDLSDEELAKRKENWAGPRETIYATGAIWKFAKLVGETYKGAVTHPGGKAERHVYMDL

SEQ ID NO: 83 - DNA, 1758 bp, Roseovarius sp.
atgaccaagttcgacaaagccaaactgcccagccgtcacgtgaccgaagggcccgagcgcgcgccgcatcggtcctattactatgccatgggcatgaccgagacggaaattcatcagccgctcgtgggcgtggcgacctgctggaacgaagcagccccctgcaacatcgcgctgaaccgtcaggcgcaggcggtcaagggtggcgtgaaagaggcgcatggcagcccgcgtgagtttaccacgatcacggtcacggacgggattgcgatggggcatgagggcatgcggtcgagccttgcgagccgggaggcaattgccgatacggtggaattgaccatgcgtggacattgctatgacgcgctggttggtttggcgggttgtgacaaatccctgcctggaatgatgatggcgatggtgcggttgaacgtgccgtccgtgttcatttatggcgggtcgatcctgccgggcaaggccccgcaggtcgaggagattccggcggatttccgcagccgtgatctgaccgtgcaggacatgttcgaggcggtggggcggcatcagaacaacgagatgtccgacaaggcgctggatatgctggagcgggtggcctgcccatcggcgggggcctgtggcgggcagttcaccgccaacaccatggcctgtgtttctgaggcgattggtctggcgttgatgaattcctcgggtatgcctgccccttatgaaagccgcgatcaatatgccgaggcgtctggtcgtgcggtgatgcatcttttggagcgcaacatccgggcgcgggacgtggtgacgctcaagtcgttgcagaatgcggcgcgggttgtggcctgcaccggtggcagcaccaatgccggtttgcacctgcctgcgattgcgcatgaggcggggattgatttctttctcgaagatgtctgcgacatcttccgcgacacgccctatttcgtcgatctgaaaccgggcggggcctatgtggccaaagacctttatgatgccggtggtatcccggttgtgatgaaggaattgcgcaaggccggtctgattcatgaggattgcatcaccgcgagcgggcgcagcatcggcgaggagctggacctgatcgagcgcgaagccgatggcaaggtcatctatccgattgaaacgccgatcaccaagacggggggcgttgtcggtctcaagggcaatctggccccgaccggcgcgattgtgaaagtggcgggcattgcgcccgagcatcaggtctttaccggcccggcgcgggtgtttgaatgtgaagaagacgcattcgaggccgtcaaagcgcgcgcctataaagagggcgaggtgatcgtcatccgcaatgaaggcccggcaggcggccccggcatgcgcgagatgctgtcgaccacagcggcgctgagcggtcagggcatgggcaagaaggtggcgctgatcaccgacgggcggttctctggggcgacacgcgggttctgtgtgggccatgttggaccagaggccgcgcatggtggcccgattgccttgattgccacgggcgacatgatcacgattgacgcgatcaagggggaattgtcggttgatctgagcgacgaggaactggccaagcgcaaggacgcttggggcgggccgcgcgagacgatctataccagcggggcgctgtggaaatatgcgcaattggtgggcgagacctataagggcgctgtgacccatcccggcgcagcgttcgagcggcatgtctatatggacctctga

SEQ ID NO: 84 - protein, 585 aa, Roseovarius sp.
MTKFDKAKLPSRHVTEGPERAPHRSYYYAMGMTETEIHQPLVGVATCWNEAAPCNIALNRQAQAVKGGVKEAHGSPREFTTITVTDGIAMGHEGMRSSLASREAIADTVELTMRGHCYDALVGLAGCDKSLPGMMMAMVRLNVPSVFIYGGSILPGKAPQVEEIPADFRSRDLTVQDMFEAVGRHQNNEMSDKALDMLERVACPSAGACGGQFTANTMACVSEAIGLALMNSSGMPAPYESRDQYAEASGRAVMHLLERNIRARDVVTLKSLQNAARVVACTGGSTNAGLHLPAIAHEAGIDFFLEDVCDIFRDTPYFVDLKPGGAYVAKDLYDAGGIPVVMKELRKAGLIHEDCITASGRSIGEELDLIEREADGKVIYPIETPITKTGGVVGLKGNLAPTGAIVKVAGIAPEHQVFTGPARVFECEEDAFEAVKARAYKEGEVIVIRNEGPAGGPGMREMLSTTAALSGQGMGKKVALITDGRFSGATRGFCVGHVGPEAAHGGPIALIATGDMITIDAIKGELSVDLSDEELAKRKDAWGGPRETIYTSGALWKYAQLVGETYKGAVTHPGAAFERHVYMDL

SEQ ID NO: 85 - DNA, 1758 bp, Oceanicola batsensis
atgacgaaattcgacaaatcccggctgcccagccgatacgtcaccgaaggacccgagcgcgcgccgcaccgctcctacctctatgccatggggatttccgaagaagagatccaccagccgctcgtcggcgtggcgacctgctggaacgaggccgcgccctgcaacatcgcgctgaaccgccaggcgcaggccgtcaagctgggcgtgaaggcgcgcgaaggcacgccgcgcgaattcaccaccatcaccgtcaccgacggcatcgccatgggccacgaggggatgcgatcctccctcgcctcgcgcgaggccatcgccgacacggtggagctgaccatgcgcggccactgctacgacgcgatcgtcggactggcgggctgcgacaagtccctgcccggcatgatgatggccatggtacgtctgaacgtgccctcggtcttcatctacggcggttcgatcctgcccggcaaggcaccgcaggtcgacgagatccccgaggacttccgcacccgcgacctgaccgtgcaggacatgttcgaagcggtcggccgtcaccagaacaaggagttgtcggacgctgcgctcgacatgctggaacgggtggcctgcccctcctccggcgcctgcggcggccagttcaccgccaataccatggcctgcgtctccgaggcgatcgggctggcgctgctcaactcctccggcatgcctgcgccctacgagagccgcgaccagtacggcgaggcctcgggccgcgcggtcatgaacctgatcgagaagaacatccgcgcccgcgatgtcgtcacccgcaagtcgctggaaaacgccgcgcgcgtcgtggcctgcaccggcggctcgaccaacgccggcctgcacctgcccgcgatcgcgcacgaggccggcatcgactttcaccttgatgacgtctgcgagatcttccgcgacacaccctatttcgtgaacctcaagccgggcggcgaccacgtggccaaggacctgttcgacgtcggcggcatcccggtggtgatgaacgaactgcgcaaggccggcctgatccacgaggactgcgtcacggcctcgggcaagaccatcggcgaggaactcgacaccgtcacccgcaaggccgacggcaaggtgatctatccgatcgagacgccgatcaccaagaccggcggcgtggtgggcctcaagggcaacctcgcccccgaaggcgccatcgtgaaggtcgcgggcatttcggccgaggatcagaagttcaccggccccgcccgggtcttcgaatgcgaggaagacgcctttgccgccgtgcagaaacgggaatacgaggaaggcgaggtcatcgtcatccgcaacgagggccccgcgggcggtcccggcatgcgcgagatgctggccaccaccgccgccctgtccggccagggcatgggcaagaaggtcgcgctgatcaccgacggccgcttttccggcgcgacgcgcggcttctgcgttggccatgtcggccccgaggcagcgcatggcggcccgatcgcgatgctcaagaacggcgacatgatcaccatcgacgccatcgagggttcgatcgaggtcgacctctccgaggccgaactcgaggcgcgcaaggccgactggacgggccctcgcgagacgatctacgcctcgggcgcgctctggaaatatgcgcagctggtcggcaagacctatctcggcgctgtcacccatcccggcggcaaggccgagaaacatatctatgccgatctctga

SEQ ID NO: 86 - protein, 585 aa, Oceanicola batsensis
MTKFDKSRLPSRYVTEGPERAPHRSYLYAMGISEEEIHQPLVGVATCWNEAAPCNIALNRQAQAVKLGVKAREGTPREFTTITVTDGIAMGHEGMRSSLASREAIADTVELTMRGHCYDAIVGLAGCDKSLPGMMMAMVRLNVPSVFIYGGSILPGKAPQVDEIPEDFRTRDLTVQDMFEAVGRHQNKELSDAALDMLERVACPSSGACGGQFTANTMACVSEAIGLALLNSSGMPAPYESRDQYGEASGRAVMNLIEKNIRARDVVTRKSLENAARVVACTGGSTNAGLHLPAIAHEAGIDFHLDDVCEIFRDTPYFVNLKPGGDHVAKDLFDVGGIPVVMNELRKAGLIHEDCVTASGKTIGEELDTVTRKADGKVIYPIETPITKTGGVVGLKGNLAPEGAIVKVAGISAEDQKFTGPARVFECEEDAFAAVQKREYEEGEVIVIRNEGPAGGPGMREMLATTAALSGQGMGKKVALITDGRFSGATRGFCVGHVGPEAAHGGPIAMLKNGDMITIDAIEGSIEVDLSEAELEARKADWTGPRETIYASGALWKYAQLVGKTYLGAVTHPGGKAEKHIYADL

SEQ ID NO: 87 - DNA, 1764 bp, Oceanicola granulosus
atgctcaagggcaagctggacaagtcgaaactgccgagccgccatgtgaccgacggtccggcccgcgcgccgcatcggtcctacctctacgcgatgggcctctcggacgaggagatcgcgcagccgctggtcggcgtcgccacctgctggaacgaggccgcgccctgcaacatcgcgctgaaccggcaggcgcagtcggtcaagctgggcgtgcgcgccgcctcgggcacgccgcgcgagttcaccacgatcaccgtcaccgacgggatcgccatgggccacgaggggatgcgctcgtcgctggcgagccgcgaggcgatcgccgacaccgtcgagctgaccatgcgcggccattgctacgacgcgctcgtcgggctcgcgggctgcgacaagtcgctgccggggatgatgatggcgatggtgcggctcaacgtgccgtcggtgttcatctacggcggctcgatcctgccgggcaaggtgccggccggcgccgacgtcccggccgacttcgccacccgcgacctgaccgtgcaggacatgttcgaggcggtcggccggcaccaggccggcgatctgtccgatgccgcgctcgacgtgctcgagcgggtcgcctgcccctccgccggggcctgcggcggccagttcaccgccaacaccatggcctgcgtctccgaggcgatcggcctggcgctgatgaactcctccggcgcgcccgcgccctacgagagccgcgaccagtacagcgtcgcctcgggcgaggcggtgatgaagcttctcgagagcaacatccgcgcccgcgacgtcgtcacccgcaagagcctcgagaacgccgcccgggtcgtcgcctgcaccggcggctcgaccaacgccggcctgcacctgccggccatcgcgcacgaggcggggatcgacttcgacctgttcgacgtctgcgacatcttccgcgacaccccctacttcgtcgacctcaagcccggcggccagtacgtggctaaggacctgttcgaggccggcggcgtgcccgtggtgatgaaggagctgcgcaaggccgggctgctgcacgaggactgcatcaccgccagcggcgagacgctcggcgaggcgctcgacaagatcaccggcgaggccgacggccgcgtcatccatcccgtcgccaccccgatcagcaagaccggcggcgtcgtcgggctgaagggcaacctcgccccggaaggtgcgatcgtgaaggttgccggcatggacgccgagcagcaggtcttcaccggcccggcgcgggtgttcgagtgcgaggaggacgccttcgaggcggtcaaggcgcgcagctacaaggaaggcgaggtcatcgtcatccgcaacgagggccccgccggcggccccggcatgcgcgagatgctggccaccaccgccgcgctctccgggcagggcatgggcaagaaggtcgcgctcatcaccgacggccgcttctcgggcgcgacgcgcggcttctgcgtcggccatgtcggccccgaggccgcccatggcgggccgatcgcgatgctcgagaatggcgacatgatcaccatcgacgccatcaagggcgagatctccgtcgcgctgaccgaggagcagttcgccgagcgcaaggccgcctggccgggcgcgcgcaagacggactacgcctcgggcgcgctgtggaagtacgcccagctcgtcggctccacccgtctcggcgcggtgacccatccgggcgcgaaggcggagacgcacgtctacatggatctctga

SEQ ID NO: 88 - protein, 587 aa, Oceanicola granulosus
MLKGKLDKSKLPSRHVTDGPARAPHRSYLYAMGLSDEEIAQPLVGVATCWNEAAPCNIALNRQAQSVKLGVRAASGTPREFTTITVTDGIAMGHEGMRSSLASREAIADTVELTMRGHCYDALVGLAGCDKSLPGMMMAMVRLNVPSVFIYGGSILPGKVPAGADVPADFATRDLTVQDMFEAVGRHQAGDLSDAALDVLERVACPSAGACGGQFTANTMACVSEAIGLALMNSSGAPAPYESRDQYSVASGEAVMKLLESNIRARDVVTRKSLENAARVVACTGGSTNAGLHLPAIAHEAGIDFDLFDVCDIFRDTPYFVDLKPGGQYVAKDLFEAGGVPVVMKELRKAGLLHEDCITASGETLGEALDKITGEADGRVIHPVATPISKTGGVVGLKGNLAPEGAIVKVAGMDAEQQVFTGPARVFECEEDAFEAVKARSYKEGEVIVIRNEGPAGGPGMREMLATTAALSGQGMGKKVALITDGRFSGATRGFCVGHVGPEAAHGGPIAMLENGDMITIDAIKGEISVALTEEQFAERKAAWPGARKTDYASGALWKYAQLVGSTRLGAVTHPGAKAETHVYMDL

SEQ ID NO: 89 - DNA, 1728 bp, Rhodobacterales bacterium
atgacgaaatttgacaaaaccaacctgcccagccgccatgtaaccgagggtcctgcgcgtgcgccgcatcgttcgtatttatatgctatggggttgtctgaagatgaaattcaccagcctctagtcggtgttgccacatgctggaacgaggcggccccctgtaatatcgccctgaaccgtcaggcgcaatctgtgaaaatgggcgtcaaacaagcgatgggtacgccacgcgaattcaccacgattaccgttacagacggtattgcgatgggtcacgaaggtatgcgttcgtctttggccagccgcgaggcaatcgctgacacggttgaattgaccatgcgcggtcattgctatgatgcgatcgttggtcttgctggttgtgacaagtcattgcccggtatgatgatggcgatgatccgtttaaacacaccgtctgtgtttgtttatggcggttcaatcttgcccggtcgttacgagggtcgcgatgttactgtacaggacgtttttgaggccgtcggccagcaccaagctggaaacctttcgtcttgcgagcttgaaaaactagaagcggttgcttgtccttctgcgggtgcttgtggtggtcagtttaccgccaacaccatggcttgtgtttccgaggcaatcggtcttgccttgccaaattccgcgggcgcaccggcaccgtatgaaagccgtgatcaattctgcgaggcatccggccgcgctgttatgaatttgatcgccaaaaacattcgtgcgcgtgacatcgtaacacgtaaatcattggaaaatgcggcacgtgttgttgcttgtactggtggttcaacgaatgcaggtcttcacttgccagccatggcgcatgaggcaggcattgatttttatctggatgacgtttgtgacatcttccgcgaaacgccttatttcgtcgatctgaaaccaggtggtaattatgtagccaaagacctttatgaggttggtggcgttcccgtaattatgcgtgaattgcgcaaagcggggttgatccacgaggattgcatgacagccactggccgcacaatgggcgaagagattgatcttgttgatcgcgaagcggacggtaaagtgatttaccccgttgatgccccgttgacgaaaactggcggcgttgttggccttaaaggtaacttggccccagaaggcgcgattgtgaaagtggcgggtatcccatcacagcaccaagtgttttccggccctgcccatgtttttgaatgtgaacaggacgcttttgaagccgtgcaaaaccgtgactacaaagaaggcgaagtattcgtcattcggaacgaaggcccatcaggtggccctggcatgcgtgaaatgttggcaacgaccgccgccctttctggtcaaggcatgggtaaaaagatcgccctgattacagatggtcgcttttctggtgcaacacgtggtttctgtgttggtcacgttggaccagaggcggctcatggtggcccgattgcgttggttgaaaatggtgacatcatcaccatcaatgcaattgaaggcgaaatttcggttaatttgactgatgatgagttggctgaacgtaagacaaactggaaaggaccacgcgaaacgatctatgcgtctggtgctttgtggaaatacagtcagcaagttggcgaagtatacaagggtgctgttacccatccaggtggcaaagccgaaaaacacgtttacatggatttgtaa

SEQ ID NO: 90 - protein, 575 aa, Rhodobacterales bacterium
MTKFDKTNLPSRHVTEGPARAPHRSYLYAMGLSEDEIHQPLVGVATCWNEAAPCNIALNRQAQSVKMGVKQAMGTPREFTTITVTDGIAMGHEGMRSSLASREAIADTVELTMRGHCYDAIVGLAGCDKSLPGMMMAMIRLNTPSVFVYGGSILPGRYEGRDVTVQDVFEAVGQHQAGNLSSCELEKLEAVACPSAGACGGQFTANTMACVSEAIGLALPNSAGAPAPYESRDQFCEASGRAVMNLIAKNIRARDIVTRKSLENAARVVACTGGSTNAGLHLPAMAHEAGIDFYLDDVCDIFRETPYFVDLKPGGNYVAKDLYEVGGVPVIMRELRKAGLIHEDCMTATGRTMGEEIDLVDREADGKVIYPVDAPLTKTGGVVGLKGNLAPEGAIVKVAGIPSQHQVFSGPAHVFECEQDAFEAVQNRDYKEGEVFVIRNEGPSGGPGMREMLATTAALSGQGMGKKIALITDGRFSGATRGFCVGHVGPEAAHGGPIALVENGDIITINAIEGEISVNLTDDELAERKTNWKGPRETIYASGALWKYSQQVGEVYKGAVTHPGGKAEKHVYMDL

SEQ ID NO: 91 - DNA, 1734 bp, Paracoccus denitrificans
atgaaaaacagccgcttcgacaagtcgtccctgcccagccgccatgtgaccgaagggccggcccgcgcgccgcatcgcagctatttctatgccatgggcatatcggaggaagaaatccattccccctgggtgggcgtcgccacctgctggaacgaggccgcgccctgcaacatcgcgctggcccgacaggcgcaatcggtcaagcagggcgtcaagaagggtggcggctgcccgcgcgaattcaccaccatcaccgtcaccgacggtattgccatgggacatgaggggatgcgctccagcctcgcctcgcgcgatgccatcgccgatacggtcgagctgaccatgcgcgggcattgctacgacgcgctggtcgggctggcgggctgcgacaagtcgctgccgggcatgatgatggccatggtgcggctgaacgtgcccagcgtcttcatctatggcggctcgatcctgccgggcaagctcaacggccgcgacgtggtggtgcaggacgtgttcgaggcggtgggccagcacgcggccggcaacatgtccgatgccgagctggagatcctggagcgcgtggcctgcccctcggccggggcctgcggcgggcaatataccgcgaacaccatggcttgcgtgtcggaagccatcgggctggcgctgatgaacagctcgggcgcgccggcgccttacgaatcgcgcgaccagtatgggctggcctcgggcgaggcggtgatggcgctgatcgaaaggaacatccgtgcccgcgacgtggtgacgcgcaaatcgctggaaaacgcggcgcgggtggtggcctgcaccggcggctcgaccaatgccgggttgcacctgcccgccatcgcgcatgaggcggggatcgaattcgacctgttcgacgtctgcgagatcttccgcgacacgccctatttcgtgaacctgcgcccgggcggcgattacgtcgccaaggacttgttcgaggccgggggcgtcccggtcgtcatgcgcgaattgcgccgcgccgggctgatccacgaggattgcctgaccgcctcgggccgcagcatgggcgaggagctggacctggtcaagcgcgaggccgacggcaaggtgatccatccggtgacggcgccgctgtccaggaccggcggcgtggtcgggctgcgcggcaacctggcgcccgacggcgccatcgtgaaggtcgcgggaatggcgcccgagcaccaggtctttaccggccccgcccgggtcttcgaatgcgaggaagaggcgttcgaggccgtcgcccgccgcgattacagcgagggctgcgtgatcgtcatccgaaacgaggggccggccggcggccccggcatgcgcgagatgctggcgaccacggcggcgctgtcggggcagggcatgggcaagaaggtggcgctgatcaccgacgggcggttctcgggcgcgacgcgcggcttctgcgtcggccatgtcggtcccgaggcggcgcatggcggccccatcgccctgctgcgcgacggcgacatgatcaccatcgacgcgatcaggggcgagatctcggtggcgctgccggacgaggaactgacgcggcgccgcgccgcatgggcgggaccgcgcaagaccgactatgcctcgggcgcgctgtggaaatacgcccagttggtcggcaaggcgcgctatggcgcggtcacccatccgggcgcggcggccgaaacccatgtctatatggatcagtga

SEQ ID NO: 92 - protein, 577 aa, Paracoccus denitrificans
MKNSRFDKSSLPSRHVTEGPARAPHRSYFYAMGISEEEIHSPWVGVATCWNEAAPCNIALARQAQSVKQGVKKGGGCPREFTTITVTDGIAMGHEGMRSSLASRDAIADTVELTMRGHCYDALVGLAGCDKSLPGMMMAMVRLNVPSVFIYGGSILPGKLNGRDVVVQDVFEAVGQHAAGNMSDAELEILERVACPSAGACGGQYTANTMACVSEAIGLALMNSSGAPAPYESRDQYGLASGEAVMALIERNIRARDVVTRKSLENAARVVACTGGSTNAGLHLPAIAHEAGIEFDLFDVCEIFRDTPYFVNLRPGGDYVAKDLFEAGGVPVVMRELRRAGLIHEDCLTASGRSMGEELDLVKREADGKVIHPVTAPLSRTGGVVGLRGNLAPDGAIVKVAGMAPEHQVFTGPARVFECEEEAFEAVARRDYSEGCVIVIRNEGPAGGPGMREMLATTAALSGQGMGKKVALITDGRFSGATRGFCVGHVGPEAAHGGPIALLRDGDMITIDAIRGEISVALPDEELTRRRAAWAGPRKTDYASGALWKYAQLVGKARYGAVTHPGAAAETHVYMDQ

SEQ ID NO: 93 - DNA, 1767 bp, Oceanibulbus indolifex
atgtccaccaccccacgcttcgacaaatcccggctgcccagccgccacgtgaccgaaggcccggcccgcgcgccgcatcggtcttactactatgccatgggcatgaccgagcaagagattcaccagccgctggtgggcgtcgccacctgctggaacgaagcagcgccctgcaacatcgcgctgagccgtcaggcgcaggccgtgaagatcggtgtgcattccgaacagggcacgccgcgcgagtttaccacgatcaccgtcaccgatggtatcgcgatgggccacgagggcatgcgctcctcgctcgcgtcgcgcgaagcgattgccgacacggttgagctgaccatgcgcggccactgctatgacgccatcgtgggcctcgcgggctgcgacaaatctctgccggggatgatgatggcgatgctgcggttgaacgtgccgtcggtcttcctctatggcgggtcaatcctgccgggcaaagcacctgccggggccgatgtgcccgaggatttcgccagccgcgatctgaccgtgcaggacatgttcgaagcggtgggccggttccagaacggcaccatgtcgcaagcagccctcgacgtgcttgagcgcgtggcttgcccatcggcgggcgcttgtggcggccagttcaccgccaatacaatggcctgcgtctccgaggcgatcggcctcgcgctgcccaactcgtccggcatgcccgcgccctatgagagccgcgacgcctatgccgaggcctctggcgcggcggtgatgaacctgatcgaaaagaacatccgcgcccgcgacatctgcacccgcgaagcctttgaaaacgcagcgcgcatcgtggcctgcaccggcggctcgaccaacgcgggcctgcacctgcccgccatggcgcatgaagccgggatcgagttctacctcgaagacgtttgcgaaatcttccgcgacacaccctatttcgtcgatatgaaaccgggcggcgcttatgtggccaaagatctttacgatgcgggcggcgtgccggtggtgatgaatgagttgcgcaaagcgggcctcattcacgaagactgcatgactgccaccggctactccatgggcgaagtgctcgatcaggttacccgcgaagcagacggcaaggtgatccactcggtcgccaatccgatcagcaagaccggcggtgtcgtgggcctcaaaggcaacctcgcccccgaaggtgccatcgtgaaaatcgcgggcatgtctgacgaagacatcgtcttcaccggcccggcactggtgttcgaatgtgagcaagacgctttcgaagccgtgcaaaaccgcgcctattccgaaggcgacgttttcgtcatccgcaacgaaggccccgcaggcggccccggcatgcgcgagatgctggccaccaccgccgcgctttcgggtcaaggcatgggcaagaaggtggcgctgatcaccgatggccgcttctcgggtgcgacacgtggcttctgtgtgggtcacgttggccccgaagcggcgcatggcggaccgattgcgctgctgaaaaacggcgacatgatcacccttgatgcgatcaaaggttccatcagcgtcgacctgagcgatgatgagcttgccgagcgccgcaagggctgggctggcccgcgtgccacaaactaccaaagcggcgcgctgtggaaatacgccaaacttgtcggccctacctaccttggtgccgtgacacatccgggcgctcaggccgagacccatgattacatggacctctaa

SEQ ID NO: 94 - protein, 588 aa, Oceanibulbus indolifex
MSTTPRFDKSRLPSRHVTEGPARAPHRSYYYAMGMTEQEIHQPLVGVATCWNEAAPCNIALSRQAQAVKIGVHSEQGTPREFTTITVTDGIAMGHEGMRSSLASREAIADTVELTMRGHCYDAIVGLAGCDKSLPGMMMAMLRLNVPSVFLYGGSILPGKAPAGADVPEDFASRDLTVQDMFEAVGRFQNGTMSQAALDVLERVACPSAGACGGQFTANTMACVSEAIGLALPNSSGMPAPYESRDAYAEASGAAVMNLIEKNIRARDICTREAFENAARIVACTGGSTNAGLHLPAMAHEAGIEFYLEDVCEIFRDTPYFVDMKPGGAYVAKDLYDAGGVPVVMNELRKAGLIHEDCMTATGYSMGEVLDQVTREADGKVIHSVANPISKTGGVVGLKGNLAPEGAIVKIAGMSDEDIVFTGPALVFECEQDAFEAVQNRAYSEGDVFVIRNEGPAGGPGMREMLATTAALSGQGMGKKVALITDGRFSGATRGFCVGHVGPEAAHGGPIALLKNGDMITLDAIKGSISVDLSDDELAERRKGWAGPRATNYQSGALWKYAKLVGPTYLGAVTHPGAQAETHDYMDL

SEQ ID NO: 95 - DNA, 1767 bp, Sulfitobacter sp.
atgtccaccaacacccgctttgataaatccagactgccaagccggcacgtgaccgaggggccagagcgcgcaccgcaccggtcctattactacgcaatgggcatgaccgaagaagagattcaccagcctctggtgggtgtggcaacctgctggaacgaagcggccccctgtaacatcgcgctgaaccgtcaggcccaagcggtcaaggtcggcgtcaaggcgcagcaaggcacgccacgcgaattcaccaccatcactgtcaccgacgggatcgccatgggccacgagggcatgcgctcttccctagcgtcgcgcgaagcgattgccgacacggtagagctgacaatgcgcggtcactgctacgatgcgattgtcggtcttgcgggctgtgacaaatcgctgccgggcatgatgatggcgatgctgcggctgaacgtgccgtccgtgttcctctacggtgggtcgatcctgccgggcaaagtcccggaaggggccgatgtgcctgccgatttcgccagccgcgatctgactgtgcaagacgttttcgaagccgtgggtaactaccagaacggcagcatgtcgcaagccgcgcttgaagtattggagcgcgtcgcttgcccgacagccggtgcctgcgggggccagttcaccgccaacactatggcctgcgtgtccgaggcaattggtctggcgctgctgaactcctctggcatgcctgcgccctatgaatcccgcgacgcctatgcggcggcctcgggtgaagccgtcatgaacctgatcgaaaagaacatccgcgcgcgcgacatctgcacccgcgaagcgttcgagaatgcggcgcgtatcgtggcctgcaccggcgggtcgaccaatgccggtctgcacctgcccgctatggccgccgaggcgggtatcgactttaacctcagcgatgtgtgcgacatcttccgcgacacgccttatttcgtcgacatgaaacccggcgggtcgcatgtggcaaaagacctgtatgacgcgggcggcgtgcctgttgtgatgaaagaactgcgcaaggctggcctgctgcatgatgactgtctcaccgcctcgggcctgtccatcggtgaagagctcgacaagatcgaacgcgaagccgacggcaaggtgatccacgcgatcgaaacaccgatcagcaagaccggcggcgtcgttggtctgaagggcaacttggcacccgaaggggccatcgtgaaaatcgcgggcatgtccgaagaagacatcgtctttaccggtccggcgctgatctttgaatgtgaacaggatgcgttcgaagccgtgcaaaaccgggcctacagcgaaggcgacgtgttcgtgatccgcaacgaaggccccgctggtggccccggcatgcgcgaaatgctggcgaccacggcggccctgtccggtcaaggcatgggcaaaaaggtggcactgatcaccgacggccgtttctccggcgcgacacggggtttctgcgttggtcacgtcggccccgaagccgcacatggcggaccgattgccttgctcaaacagggtgacatgatcacactgaacgcgatcaccggttcgatctctgtcgatatctcggacgaggaaatggcagaacgcaaagcggcttggcccggtgcccgcaaaacaaactatcaaagcggtgcactgtggaaatacgcgcagcttgtgggcccaacctatcttggtgcggtgacgcatcccggcgcgaaggcggaaacacatgactatatggacctgtaa

SEQ ID NO: 96 - protein, 588 aa, Sulfitobacter sp.
MSTNTRFDKSRLPSRHVTEGPERAPHRSYYYAMGMTEEEIHQPLVGVATCWNEAAPCNIALNRQAQAVKVGVKAQQGTPREFTTITVTDGIAMGHEGMRSSLASREAIADTVELTMRGHCYDAIVGLAGCDKSLPGMMMAMLRLNVPSVFLYGGSILPGKVPEGADVPADFASRDLTVQDVFEAVGNYQNGSMSQAALEVLERVACPTAGACGGQFTANTMACVSEAIGLALLNSSGMPAPYESRDAYAAASGEAVMNLIEKNIRARDICTREAFENAARIVACTGGSTNAGLHLPAMAAEAGIDFNLSDVCDIFRDTPYFVDMKPGGSHVAKDLYDAGGVPVVMKELRKAGLLHDDCLTASGLSIGEELDKIEREADGKVIHAIETPISKTGGVVGLKGNLAPEGAIVKIAGMSEEDIVFTGPALIFECEQDAFEAVQNRAYSEGDVFVIRNEGPAGGPGMREMLATTAALSGQGMGKKVALITDGRFSGATRGFCVGHVGPEAAHGGPIALLKQGDMITLNAITGSISVDISDEEMAERKAAWPGARKTNYQSGALWKYAQLVGPTYLGAVTHPGAKAETHDYMDL

SEQ ID NO: 97 - DNA, 1764 bp, Roseobacter denitrificans
atgtccagccagcgctttgataaatccaagctgcccagccgccatgtgaccgagggaccctcacgggcgccgcatcggtcctactattacgcgatgggcatgacggaggaagaaatccatcaaccgcttgttggcgtggccacttgctggaacgaggccgccccctgcaacatcgcgctgaaccgccaggcgcaatcggtcaagatgggcgtgaaacgcgaaagcggcacgccacgtgaattcaccaccatcaccgtcaccgacggcatcgcgatgggccacgagggcatgcggtcgtcactggcgtcacgcgaggcaattgccgatacggtggaactgaccatgcgcgggcattgctatgacgcacttgtggggctggcgggctgcgacaaatccctgccgggcatgatgatggcgatgatccgtctgaatgtgccatcggttttcctttatggcgggtcaatcctgccgggacgtgcgcccaagggggcgtcggtgcctgccgaatacgccgaccgcgacctgaccgttcaggacatgttcgaagctgttgggcatcaacagaacggcaccctgagcgaggcagaactcgaagtgctcgaacgcgtcgcctgcccttctgccggggcttgtggcgggcagtttaccgccaacaccatggcctgtgtatccgaggccatcggtctggcgttgcccaattccgccggggcacctgcgccgtacgaatcccgcgacgcctatgccgaagcctcgggtgcggcggtcatgaacctgatcgaaaagaacatccgtgcgcgcgacatctgcacgcgggaggccttcgagaatgccgcgcgcatcgtcgcttgtacgggcgggtcgaccaacgccggtctgcacctgcctgccatggcgcatgaagcgggcatcgatttcttcctcgaagacgtctgcgagatcttccgcgacacgccctatttcgtcgatctgaaaccgggcgggcagtatgtcgccaaggacatgtacgaagccggcggcgtgcccgtggtaatgaaagagctgcgcaaggcaggcctgttgcacgaggactgcatgaccgtcaccggctattccatcggcgaggaactggacaaggtcagccttgaggcggatggccgagttgtctatccgattgaaacaccgctgtcgaaaaccggtggcgtcgtcggcctcaagggcaaccttgcccccgaaggagccatcgtgaaaatcgccggaatggagccgcagcatttgctgttcaccggccctgcgcgaatctttgagtgtgagcaggacgcgtttgaagccgtccagaaccgcacctacaaagagggcgatgtctttgtcatccgcaacgagggccctgctggcggccccggcatgcgcgagatgctggcaacgacggcggcgctttcgggtcagggcatgggcaagaaagtcgcgctgatcacggatggacgtttctcgggggcgacacgcgggttctgcgtcggccatgtgggtcccgaggccgcgcacggaggccccatcgccttgctcaaggatggcgatatgatcacgcttaacgcgatcgaggggaccatcaccgtcgatgtgtccgacgaggagatggccgagcgtaaagccaattggaaaggggcgcgtccaacgatctatggtgctggtgccttgtggaaatacgcgcaacttgtggggccaacctatctcggggccgtgacccatccgggcggtaaagacgaaggccacgcgtacatggaactgtaa

SEQ ID NO: 98 - protein, 587 aa, Roseobacter denitrificans
MSSQRFDKSKLPSRHVTEGPSRAPHRSYYYAMGMTEEEIHQPLVGVATCWNEAAPCNIALNRQAQSVKMGVKRESGTPREFTTITVTDGIAMGHEGMRSSLASREAIADTVELTMRGHCYDALVGLAGCDKSLPGMMMAMIRLNVPSVFLYGGSILPGRAPKGASVPAEYADRDLTVQDMFEAVGHQQNGTLSEAELEVLERVACPSAGACGGQFTANTMACVSEAIGLALPNSAGAPAPYESRDAYAEASGAAVMNLIEKNIRARDICTREAFENAARIVACTGGSTNAGLHLPAMAHEAGIDFFLEDVCEIFRDTPYFVDLKPGGQYVAKDMYEAGGVPVVMKELRKAGLLHEDCMTVTGYSIGEELDKVSLEADGRVVYPIETPLSKTGGVVGLKGNLAPEGAIVKIAGMEPQHLLFTGPARIFECEQDAFEAVQNRTYKEGDVFVIRNEGPAGGPGMREMLATTAALSGQGMGKKVALITDGRFSGATRGFCVGHVGPEAAHGGPIALLKDGDMITLNAIEGTITVDVSDEEMAERKANWKGARPTIYGAGALWKYAQLVGPTYLGAVTHPGGKDEGHAYMEL

SEQ ID NO: 99 - DNA, 1764 bp, Jannaschia sp.
atgaccgccaacaggccagacaaatccagattgcccagtcgccatgtgaccgaaggacccgagcgcgcgccgcatcggtcgtatttctacgccatggacctgacacaggagcagatcgaccagccattcgtcggcgtcgccacctgctggaacgaagcggccccttgcaacatcgcgctcaactggcaggcgcaatcggtgaaacgcggtgtgggtgaggcgaacggtacgccgagggaattcaccacgatcaccgtcaccgacggcattgcgatggggcatgaagggatgcggtcctcgctggcgtcgcgcgatgcgatcaccgacacggtggaactgacgatgcgcggccactgctatgacgcattggtcgggcttgccgggtgcgacaagtccctgcccggcatgatgatggccatggtgcgcctgaacgtgccgtccgtcttcatctatggcggcacgatccttcccggcaaagcgcctgaagttgccgacattcccgccgagtttgccaaccgtgacctgaccgtgcaggacatgttcgaggccgtgggcaagtaccagtccggccaattgagcgaagccgccctggaagttctggaacgcgttgcctgcccgtctgcgggcgcctgtggcggtcagttcaccgccaacaccatggcatgtgtgtccgaggcgattggtctggcaatgctcaactcctccgggatgcctgcgccttacgaggggcggaaggaattcggcgaggcaagcggtcgcgcggtgatgaacctgcttgaaaagaacatccgcgcccgtgacgtcgtcacccgcaaagcgttggagaatgcggcccgtgttgtggcgtgtaccgggggctccaccaatgcaggtctgcaccttcccgcgattgcccatgaggccggaatcgacttcgacctctttgacgtctgcgacatcttcaaggacacgccctacttcgtcgacatgaaacccggcggtcagtatgtggcgaaagacctctatgaggtgggcggcgtgccagtcgtgatgaaggagctgttgaaagaggggctgttgcacggcgattgcctcactgcctctggcgagacgatggaagaggcgctcgacaagatccagggcacgcccgatggccgtgtggtccatacggtccagaacccgatcaccagcaccggcggcgtggtcggcctgcgcggcaatctcgccgaagagggtgcgatcgtgaaagttgcgggcatggatgaggcaagccaggtcttcaccggacccgcgcgcgtgtttgaatgcgaagaagacgcctttgccgccgtgaaggcgcgcggctacgaggaaggcgaagtcattgtcatccgcaatgaagggccaaagggcggcccgggcatgcgggaaatgttggcgacgacggcggcattgtcgggtcagggcatgggcaagaaggtggccctgatcaccgacggccggttctctggtgcaacgcggggcttctgcgtcggtcacgtgggacctgaggcggctgttggcggaccgattggtctgctggagaacagcgacatgatcaccatcaatgcgctgacgggggaactgtcggttgccttgaccgaggcggaattggccgagcgtcggaaggcctgggccggtccgcgtgagacaatgtacgcctctggcgcgttgtggaaatacgcgcaattggtgggagaggcgcgctatggcgcggtgacccatcccggcggggccaaggaaaagcacgtctatgcggacatctag

SEQ ID NO: 100 - protein, 587 aa, Jannaschia sp.
MTANRPDKSRLPSRHVTEGPERAPHRSYFYAMDLTQEQIDQPFVGVATCWNEAAPCNIALNWQAQSVKRGVGEANGTPREFTTITVTDGIAMGHEGMRSSLASRDAITDTVELTMRGHCYDALVGLAGCDKSLPGMMMAMVRLNVPSVFIYGGTILPGKAPEVADIPAEFANRDLTVQDMFEAVGKYQSGQLSEAALEVLERVACPSAGACGGQFTANTMACVSEAIGLAMLNSSGMPAPYEGRKEFGEASGRAVMNLLEKNIRARDVVTRKALENAARVVACTGGSTNAGLHLPAIAHEAGIDFDLFDVCDIFKDTPYFVDMKPGGQYVAKDLYEVGGVPVVMKELLKEGLLHGDCLTASGETMEEALDKIQGTPDGRVVHTVQNPITSTGGVVGLRGNLAEEGAIVKVAGMDEASQVFTGPARVFECEEDAFAAVKARGYEEGEVIVIRNEGPKGGPGMREMLATTAALSGQGMGKKVALITDGRFSGATRGFCVGHVGPEAAVGGPIGLLENSDMITINALTGELSVALTEAELAERRKAWAGPRETMYASGALWKYAQLVGEARYGAVTHPGGAKEKHVYADI

SEQ ID NO: 101 - DNA, 1731 bp, Caulobacter sp.
atgaccaagaaacccgacgggacctgggacaagtcgcaactgcccagccggcatgtaaccgaagggccggcccgcgcgccgcaccgctcttattattacgccatgggtcttggcacgcgtgagatcgcccagccgttcgtcggcgtcgcctcgtgctggaacgaggccgcgccctgcaacaccgccctgatgcgccaggccaacgccgtggccaagggcgtcaaggcggccggcggcaccccgcgcgagttctgcaccatcaccgtcaccgacggcatcgccatgggccacgagggcatgcgttcgtccctggtcagccgcgacgtgatcgccgactccgtcgagctgaccatgcgcggccacggctatgacgcgctcgtgggcgtcgccgggtgcgacaagagcctgccgggcatgatgatggccatgctgcgcctcaacgtgcccagcgtgttcctgtacggcggctcgatcctcccgggacgcttccagggccgcgacatcaccgtgatggacgtcttcgagggcgtcggcgcctatgccgccgggaccatggacgccaagaccctgtgcgagctggagcagcacgcctgcccgtcggacggcgcctgcggcggccagttcacggccaacaccatggcctgcgtgtcggaagccatcggcctggccctgccgctgtcctcggccctgccggccccgtacctggaccgcgaccagtacgcggtggcctcgggcgaggcggtgatgcggctgatcgagcagaacatccgcccgcgcgatatctgcacccgcaaggccttcgagaacgccgccgtcgtcgtcgcggccaccggcggttcgaccaatggcgcgctgcacctgccggccatggcccacgagtgcggcatcgagttcaccctcaaggacgtggccgagatcgccgcccgcacgccctatatcgccgacctcaagcccggcggtcgctacgtggccaaggacatgggcgaggccggcggcgtgccgatgctgctgcgcaccctgctggacgccggcctgctgcacggcgacgtcatgaccgtcaccggcaagaccctggccgagaacctggccgatgtggtctggcgtgaggaccaggacgtgatccgcccggtctccaatccgctgtcgccgactggcggcgtggtcggcctgtggggctcgctggcgcccgagggcggcatcgtcaaggtggccggcctcaagcaccaggtgcaccgcggcccggcccgggtgttcgacggcgaggcggcctgtttcgaagcggtgtcgaaccgcgactacaaggcaggcgacgtcctggtcatccgctacgaaggtccgcgcggcgggccgggcatgcgcgagatgctgtcgacgaccgccgcgatctacggccagggcgtggagaacatcgccctgatcaccgacggccgcttctcgggcgccacgcgcggcctgtgcatcggccacgtgggtcccgaggccgccgtgggcggtccgatcgccctggtgcaggacggcgacatcatcagcatcgacgccaccaaggggacgatcgagcttgaggtcgaggccgaggaactggcgcgccgcaaggccgcctggaagccgcgcggccacgactacaacagcggcgcgatctggaagttcgcccaactggtcggtccagcctatcttggcgccacgacccatccgggcgcggccaaggagacgcacgtctacgcggacatctga

SEQ ID NO: 102 - protein, 576 aa, Caulobacter sp.
MTKKPDGTWDKSQLPSRHVTEGPARAPHRSYYYAMGLGTREIAQPFVGVASCWNEAAPCNTALMRQANAVAKGVKAAGGTPREFCTITVTDGIAMGHEGMRSSLVSRDVIADSVELTMRGHGYDALVGVAGCDKSLPGMMMAMLRLNVPSVFLYGGSILPGRFQGRDITVMDVFEGVGAYAAGTMDAKTLCELEQHACPSDGACGGQFTANTMACVSEAIGLALPLSSALPAPYLDRDQYAVASGEAVMRLIEQNIRPRDICTRKAFENAAVVVAATGGSTNGALHLPAMAHECGIEFTLKDVAEIAARTPYIADLKPGGRYVAKDMGEAGGVPMLLRTLLDAGLLHGDVMTVTGKTLAENLADVVWREDQDVIRPVSNPLSPTGGVVGLWGSLAPEGGIVKVAGLKHQVHRGPARVFDGEAACFEAVSNRDYKAGDVLVIRYEGPRGGPGMREMLSTTAAIYGQGVENIALITDGRFSGATRGLCIGHVGPEAAVGGPIALVQDGDIISIDATKGTIELEVEAEELARRKAAWKPRGHDYNSGAIWKFAQLVGPAYLGATTHPGAAKETHVYADI

SEQ ID NO: 103 - DNA, 1719 bp, Candidatus Pelagibacter ubique
atggcaaaatttaataaaaaaaaattaccaagcagacatacttcattaggtgctgatagagctccacatagatcattttactatgcaatgggtgaaacagaaaaagatgtagcaaagccatttgttggtgttgtgtcaacttggaatgaagctgctccttgtaatattgctttaatgagacaagctcaatctgtcaaaaaaggcgttagagcttcaggtggaacccctagagaattttgtacgataacagtaactgatggtattgccatgggtcacgaaggaatgaagtcatctttaatctctcgcgaggtaattgctgattcaactgaacttactgtgcgtggtcattgttatgatgcgcttgttggtattgctggttgtgataaatctttacctgccttaatgatggcaatggttagattaaatgttccaagtgtatttatttatggtggctcaatacttccaggtcaatataaaggtaaagatgtaactgttgttgatgtttttgaagcagttggaaaacactcagctggaaaaatgtctgcaaaggaattaagaaaattagagttagttgcttgcccaagtgcaggtgcatgtggaggtcaatttactgcaaatactatggcctgcgtttctgaagctattggtttagcattaccttattcagctggaacacctgctccatacgaagaacgtgataagtatgcattattaagtggcaagactgtaatgaatttattacaaaaaaatattcgtccaagagacattgttacaaaaaaatctttagaaaatgctgcaacaattgtagcggctactggtggatcgacaaatgctgctttacacctaccagctatagctaatgaaattggaattaagtttgatttaatggatgtagctaaaatttttaaaaaaactccatatcttgcagatttaaaaccaggtggaaaatatgttgcaaaagatatgtggttagctggtggagtacctatgttattaaaaactctttttgatggtggttttatacatggtgattgcatgactgttactggaaaaacaatgaaacaaaatttaaaaaatattaaatttaatcctaagcaaaaagtattaagagcatatgataatcctttatcaccagatggcggtgttgtaggtcttaaaggtaacttagctcctgatggtggaattgttaaaattgctggtttaaaaaaattacaattcactggaaaagctagatgttttgataatgaagaagcagcaatggcttgtgtgcaaaagaaaaaatataaagcaggtgatgtaattattattcgttacgaaggaccagttggcggtcctggtatgagagaaatgctttcaacaacaggtgctatttatggtcaaggtatgggtgagaaggttgctctaattacagatggtagattttctggggctacaagaggtttttgtgtgggtcatgttggccctgaggcggccttaggcggccctttagctcttttacgcaatggagatgtaattgatatagatgccaaaaaagggactattaacgttagattaactaaatcacaattagccacaagacataagaagtggaaagcaaaaaaatcaagctttggatcgggtactatttggaaatatgctcaaacagtaggtcccgcttatttaggtgcaccaacacatcccggtaaaagaaaagaagtaaaagtttacgctgatatttaa

SEQ ID NO: 104 - protein, 572 aa, Candidatus Pelagibacter ubique
MAKFNKKKLPSRHTSLGADRAPHRSFYYAMGETEKDVAKPFVGVVSTWNEAAPCNIALMRQAQSVKKGVRASGGTPREFCTITVTDGIAMGHEGMKSSLISREVIADSTELTVRGHCYDALVGIAGCDKSLPALMMAMVRLNVPSVFIYGGSILPGQYKGKDVTVVDVFEAVGKHSAGKMSAKELRKLELVACPSAGACGGQFTANTMACVSEAIGLALPYSAGTPAPYEERDKYALLSGKTVMNLLQKNIRPRDIVTKKSLENAATIVAATGGSTNAALHLPAIANEIGIKFDLMDVAKIFKKTPYLADLKPGGKYVAKDMWLAGGVPMLLKTLFDGGFIHGDCMTVTGKTMKQNLKNIKFNPKQKVLRAYDNPLSPDGGVVGLKGNLAPDGGIVKIAGLKKLQFTGKARCFDNEEAAMACVQKKKYKAGDVIIIRYEGPVGGPGMREMLSTTGAIYGQGMGEKVALITDGRFSGATRGFCVGHVGPEAALGGPLALLRNGDVIDIDAKKGTINVRLTKSQLATRHKKWKAKKSSFGSGTIWKYAQTVGPAYLGAPTHPGKRKEVKVYADI

SEQ ID NO: 105 - DNA, 1722 bp, Erythrobacter litoralis
atgtcgtcgagattcgacaagtccaagctgcccagccgccacgtttcggtcgggccagagcgcgcgccgcatcgttcgtattactacgcgatgggtctgaccgagcaggagatcgcgcgacccttcgtcggcattgttagcgcgggcaacgacagcgcgccctgcaacacgacgctcgatgcgcaggcggacatctgtcgcactggcgtcaaccaagcaggcggcatgccgcggcgcttcaacaccatcaccgtgacggacggtatcgccatgggacaccagggcatgaaaagctcgctggtcagccgcgaggtgattgcggactcgatcgagctatcggtgcgcgggcattgctatgatgcgctggtcggattcgccggctgcgacaagagcttgcccggcatgatgatggccatgctgcggctcaatgttccgagcatcttcgtctatggcggatcgatcctgccgggccgcttccacgacaaggacgtgaccgtcgtcgacgtgttcgaagcggtcggccagcacgcggcgggcaattgtccgctgaaagaactgaccgcgctggaaaaggtcgcctgtcccgggcacggcgcgtgcggcgggcagtttaccgccaacaccatggcctgcgtcggcgaagcgatcggcctgtcgctgcccaacagcaatatggcccccgcgccctatcgttcgcgcgaggagatcgcggtggcggcggggcggcaggtcatgacgctgctggagaaaaacctgcgcccgcgtgacatctgcacaagggccgcattcgagaatgcagcacgggtcgtcgcggcaacgggcggctcgaccaatgccgctttgcacctgcctgccatggcccatgaatgcggcatcgacttcgacctgttcgatgtcgccgagacattcaaatcaacaccttatatcgcagacctcaaacctggcgggcgctatgtcgccaaggacatgcacgaggcgggcggggtctacatggcgatgaaaacgctgctggagggcggtttcctcgatcccgaaccgatgaccgtcacaggcaagacgctgggcgagaatatcgaggagatcacctgggaccccgaccagaaggttttctacgacgtatccaatccgatcacgccgaccggcggcgtcgtcgggctcaggggttctctcgcgcccgacggggcgattgtgaaggtggcgggaatggaacggctccagttcagcggcccagcgcgagtattcgattgcgaggaggatgccttcaaggcggtcgagcagcgcgacatcgccgaaggttgcgtcatcgtaatccgctacgaaggccccaagggcggccccggcatgcgcgaaatgctctctactaccgcagcgctctacgggcagggcatgggcgagaaagtggcgctcatcaccgacgggcgcttctccggcgcgacgcgcggcttttgcatcggccatgtcggcccggaagcggcagactgcggcccgattgcgctggtcgaggatggcgatacaatcagcatcgatgccgttgcaggcacgattgagctcgacgtcgatgccgaaacgcttgaaaaacggcgtcaaagctggacaccgcgggcgaacgattaccagtccggcgcgctgtggcgctatgcgaggaacgtcggtcctgcgcatgagggcgcagtgactcatccgggagcgaaatcggaacgccatgtctttgcggatatctag

SEQ ID NO: 106 - protein, 573 aa, Erythrobacter litoralis
MSSRFDKSKLPSRHVSVGPERAPHRSYYYAMGLTEQEIARPFVGIVSAGNDSAPCNTTLDAQADICRTGVNQAGGMPRRFNTITVTDGIAMGHQGMKSSLVSREVIADSIELSVRGHCYDALVGFAGCDKSLPGMMMAMLRLNVPSIFVYGGSILPGRFHDKDVTVVDVFEAVGQHAAGNCPLKELTALEKVACPGHGACGGQFTANTMACVGEAIGLSLPNSNMAPAPYRSREEIAVAAGRQVMTLLEKNLRPRDICTRAAFENAARVVAATGGSTNAALHLPAMAHECGIDFDLFDVAETFKSTPYIADLKPGGRYVAKDMHEAGGVYMAMKTLLEGGFLDPEPMTVTGKTLGENIEEITWDPDQKVFYDVSNPITPTGGVVGLRGSLAPDGAIVKVAGMERLQFSGPARVFDCEEDAFKAVEQRDIAEGCVIVIRYEGPKGGPGMREMLSTTAALYGQGMGEKVALITDGRFSGATRGFCIGHVGPEAADCGPIALVEDGDTISIDAVAGTIELDVDAETLEKRRQSWTPRANDYQSGALWRYARNVGPAHEGAVTHPGAKSERHVFADI

SEQ ID NO: 107 - DNA, 1716 bp, Erythrobacter sp.
atgtccttcgataagtccaagttgccaagccgccatgtctcggtcgggcctgaacgcgcgccccaccgttcctactattacgcgatgggcatgaccgaggaagaaatcgcacgccccttcgtcgctgtggccagtgctggtaacgattccgcgccgtgcaacacaacgctcgatccgcaggcgaatatctgtcgcgaaggcgtcattgcggggggagggaccccgcgccgcttcaacaccatcacggttacggacgggatcgcgatgggccatcagggcatgaagagctcgctggtaagtcgcgaggtcattgcggactccgtcgagctttcggtgcgcggtcattgttacgatgcgcttgtaggatttgccggatgcgacaaaagcctgcccgggatgatgatggccatgctgcggctgaacgtgccgagcatctttgtctatggcggctcgatcctcccaggcactcatcgcggcaaggacgtgacggtcgtcgatgtgttcgaagccgtgggccagcatgctgccgggaattgcccgcttcaggagttgatcgagctcgaaaaggttgcctgtcccggacacggagcctgtggcggccagttcacagccaatacgatggcctgcgtgggtgaggcaatcggattgtcattgccgaacagcaacatggctcctgctccttacagatcgcgtgaagaaatcgctcgcgccgcgggcgagcaggtgatgatactgcttaagcaaaatctgcgcccacgcgacatctgcacgcgcgcggcctttgaaaacgcggcccgcgttgtcgccgcaaccggcggttctaccaatgccgctctgcaccttcctgccatggcgagcgaatgcgggattgatttcgatcttttcgacgttgcggagatcttcaaatcgacaccctacatcgccgacctgaagcccggcggtaagtacgtcgcaaaggacatgcacgaagcgggcggcgtctacatgggcatgaagacactgctcgaaggagggttcctcgatcccgggccgatgactgtgaccggcaagacgctgggcgagaacatcgaggagatcacctggaaccccgatcaaaaggtattctacgacgtaaagaacccgatcaccccgaccggcggtgtggttgggcttaagggctcgctcgcgcccgaaggtgcgatcgtaaaggttgccgggatggaacgtttgcaattcaccggcacggctcgcgtattcgaatgcgaggaagatgccttcgaggcggtcgagaagcgcgacattgtcgaaggcagcgtcatcgtcatccgctacgaaggccccaagggtggacctggaatgcgcgagatgctcgccaccaccgctgcgctttacggccagggtatgggtgagaaagtcgccctcatcacagatgggcggttctcaggcgctacgcgtggtttctgtatcggccatgtcggccctgaagccgcggatggcggaccgatcgctctcgtcgaggatggcgacacgatcagcatcgatgccgagcttggcacgatcgacctggaggtcgaccaaagcgtgcttgaagaacgccgaaaagcatggaagccgcgtacgaacgattatcagtcgggggcgctgtggcgttacgcgcagaatgtcgggtccgcacgaaacggagcgctcactcacccgggcgccaagtctgagacccatgtgtttgcggacatctag

SEQ ID NO: 108 - protein, 571 aa, Erythrobacter sp.
MSFDKSKLPSRHVSVGPERAPHRSYYYAMGMTEEEIARPFVAVASAGNDSAPCNTTLDPQANICREGVIAGGGTPRRFNTITVTDGIAMGHQGMKSSLVSREVIADSVELSVRGHCYDALVGFAGCDKSLPGMMMAMLRLNVPSIFVYGGSILPGTHRGKDVTVVDVFEAVGQHAAGNCPLQELIELEKVACPGHGACGGQFTANTMACVGEAIGLSLPNSNMAPAPYRSREEIARAAGEQVMILLKQNLRPRDICTRAAFENAARVVAATGGSTNAALHLPAMASECGIDFDLFDVAEIFKSTPYIADLKPGGKYVAKDMHEAGGVYMGMKTLLEGGFLDPGPMTVTGKTLGENIEEITWNPDQKVFYDVKNPITPTGGVVGLKGSLAPEGAIVKVAGMERLQFTGTARVFECEEDAFEAVEKRDIVEGSVIVIRYEGPKGGPGMREMLATTAALYGQGMGEKVALITDGRFSGATRGFCIGHVGPEAADGGPIALVEDGDTISIDAELGTIDLEVDQSVLEERRKAWKPRTNDYQSGALWRYAQNVGSARNGALTHPGAKSETHVFADI

SEQ ID NO: 109 - DNA, 1815 bp, Comamonas testosteroni
atgaacgattcccgctccaccgatccccaggccgctgtcagcggccacgctgaaccctccgactcctctgtgtcatcctccgccccgggcctgcgctcggccatcgtgcaccgcggcaccttgcgcgccagcgcgcgcagctttctgcatgcgctgggccaggacgatgaggagattgcacgcccgcatgtgggcgtgttccatacgggcggggagatgagcccctgcaatatgaatctccgcgaccaggcccagcatgccaagaccggcatctacgcgggaggcggcatgccgcacgagtgccccgtggtctcggtcagcgacggcctgaccatggcgcattcgggcatgcgcttttcgctgatctcgcgcgagctcatcgccgacagcgtggaggcctcggtgcgcggccaccagtgggacggtatctttgccgtgggtgcctgcgacaagaacctgccgggcctgatgatggccatggtgcgctgcaatgtgcccagcgtcttcgtgcatggcggctcggccctgcccgggcagatgccgggcagcgtatcggggcgcgcccttaacgtggtcgacacctacgagaccataggcaaggtgctggccggcacttccaccatgcaggagctggacaccgtcacgcgctcctgcctgccctcggccggggcctgtgccgggcagttcacggccaacaccatgggcatggtcagcgaggccctgggcctggcgcccataggctccagcatggtgccggccgtgttcagcgaacgcgcgccgctgatgcgccgcgcgggccgtcagctcatggaaatggtgtgggccagcgccaggggagaggccgtgctgccgcgcgacatcgtcacgcgcaaggccctggaaaatgcctgtgccgtggtctgcgccacgggtggctccacgaatgcggccctgcacctgccggcgatcgcgcacgaggccggcatacgctttcacctcgacgacgtggccgagatctttgcgcgcacgccgctgatcgcagacctcaagcccggcggccgcttcctggcacgtgatgtctactacatcggcggtgcggctgtcatcctgcgcaccctgctggagcagggcctgctgcatggcgatgcactcaccttcacgggccgcacgctggccgaggaggtggccgatgctgccgagcccgacggcgaagtggtgcgcaaggccggcaacccgatctcggccgacggtgggctcacggtgctcaagggcaatctgtgccctgacggtgccctgctcaagacggcggggctcaagaccctggtgcaccgcggtccggcccgcgtcttcgactccgaggaacaggcgcaggacgccgtgcaggccatggcctaccggagcggcgatgtgctggtgatacgcaacgaaggccccaagggcagccccggcatgcgcgagatgctgggcatcactgccttgctctatggccagggcatgggcgacaaggtggcactgctcaccgacgggcgcttctcgggcgccacgcgcggcctgtgcataggctacgcggggccggaggccgctgacggtgggccgattgccgcactgcaggacggcgacatcatcgccatcgatgcgcgggccggcgcgcgcagcatcacggtggagctggagcccgccgtcattgccgcgcggctggaagccgcccgggccagccgtgcgcagcagcgccccctgggcgggctgctggagaaatacgcgctgaccgtgcgtcccgcccaccagggcgcggtcacgcattcgggggcggtgacctggctgcgcgacagcaagtga

SEQ ID NO: 110 - protein, 604 aa, Comamonas testosteroni
MNDSRSTDPQAAVSGHAEPSDSSVSSSAPGLRSAIVHRGTLRASARSFLHALGQDDEEIARPHVGVFHTGGEMSPCNMNLRDQAQHAKTGIYAGGGMPHECPVVSVSDGLTMAHSGMRFSLISRELIADSVEASVRGHQWDGIFAVGACDKNLPGLMMAMVRCNVPSVFVHGGSALPGQMPGSVSGRALNVVDTYETIGKVLAGTSTMQELDTVTRSCLPSAGACAGQFTANTMGMVSEALGLAPIGSSMVPAVFSERAPLMRRAGRQLMEMVWASARGEAVLPRDIVTRKALENACAVVCATGGSTNAALHLPAIAHEAGIRFHLDDVAEIFARTPLIADLKPGGRFLARDVYYIGGAAVILRTLLEQGLLHGDALTFTGRTLAEEVADAAEPDGEVVRKAGNPISADGGLTVLKGNLCPDGALLKTAGLKTLVHRGPARVFDSEEQAQDAVQAMAYRSGDVLVIRNEGPKGSPGMREMLGITALLYGQGMGDKVALLTDGRFSGATRGLCIGYAGPEAADGGPIAALQDGDIIAIDARAGARSITVELEPAVIAARLEAARASRAQQRPLGGLLEKYALTVRPAHQGAVTHSGAVTWLRDSK

SEQ ID NO: 111 - DNA, 1707 bp, Sphingomonas wittichii
atgacgacccgaaaatttcgatccgagatcatccgcgaaggcgtggtccgaacgaccacgcgcagcttcctctacgccctgggcgaggacgacgaggatctgcggcagcctcatgtcgccgtcatccacaccggcggcgagatgagcccgtgcaacaccacgctgcgcgatcaggcgctccacgccaagacgggcatctatgcgggtggcggcacggcgcatgaatgcccggtggtgtcggtgtcggacgggctgtcggtggcgcattcggggatgcgcttctcgctgatctcgcgcgagctgatcgccgacagcgtggaggcgaccgtccggagccatcaatgggatggcgtcctcgcggtcggcggctgcgacaagaacatgcccggcctgatgatgggcatcgtgcgctgcaacgtcccctcggtcttcctctatggtggggcagccctgcccggccatctcggcggccgcgacgtcaacatcgtcgacacctatgagatgatcggccgggtcctggcgggagaggcgacgcaaggggaactggaggacatggcccgcgcctgtcttccgacggcgggagcctgtgccggccaatataccgccaacaccatgggcatggtgtcggaagcgctcggcctggcgctgctgggctcctcgatgatcccggcggtctatgccgcccgggcgccgatggcgcgcaaggcgggcaaggtgctgatgcgagcggtgctcggcggtgggccgctgccgcgcgacatcgtcacccgcaaggcgctggaaaatgcctgcgccgtggtcgccgccaccggcggttcgaccaacgcgccgctgcaccttcccgcgatcgccaacgaagcggggatcgatttcgacctcgacgatgtcgccgcagtgctcgcccgcacgccgctgatcgccgatctcaagcccggcggccgcttcctggccaaggacgtgttcgagatcggcggcaccccggtgatcctgaaggccctgctcgacggcggccatctccatggcgactgcatgacggtcaccgggcggacgctcgccgaagacctcgccaaggtctgcccgccggacggggcggtggtccgcgactgcggcatgccgatcgcgccgtccggcggcgtgaccgtgctcaagggcaatctggccccagacggcgcactgctgaagaccgccggcctgaagaagctcgagcatcgcggccccgcccgcgtcttcgagtccgaggagcaatgcctctccgccgtgcgggcgatggcctatgcggccggcgacgtcatcgtgatccgcaacgaagggccgcgcggcggccccggtatgcgcgagatgctgggcatcaccgcgctgctctacggccagggcatgggggagaaagtcgccctgatcacggacggccgcttctcgggcgcgacccggggcatgtgcatcggctatatctcgcccgaagcggccagtgatggaccgatcggcctggtccgcgacggtgatctcatcgccatcgacgcgcgcgacggcatcgtcagtttgcaggtcgaactgccaaaaggtgagttggaggcgcgtcgcgccctgccccgccccgcccgtgttcgtccgaaaggaggggtcctcgaaaaatatgcggcgatcgttggaccggccaacaagggcgccgtaacccatagcggcaacgtcatatgggagatggatccgtga

SEQ ID NO: 112 - protein, 568 aa, Sphingomonas wittichii
MTTRKFRSEIIREGVVRTTTRSFLYALGEDDEDLRQPHVAVIHTGGEMSPCNTTLRDQALHAKTGIYAGGGTAHECPVVSVSDGLSVAHSGMRFSLISRELIADSVEATVRSHQWDGVLAVGGCDKNMPGLMMGIVRCNVPSVFLYGGAALPGHLGGRDVNIVDTYEMIGRVLAGEATQGELEDMARACLPTAGACAGQYTANTMGMVSEALGLALLGSSMIPAVYAARAPMARKAGKVLMRAVLGGGPLPRDIVTRKALENACAVVAATGGSTNAPLHLPAIANEAGIDFDLDDVAAVLARTPLIADLKPGGRFLAKDVFEIGGTPVILKALLDGGHLHGDCMTVTGRTLAEDLAKVCPPDGAVVRDCGMPIAPSGGVTVLKGNLAPDGALLKTAGLKKLEHRGPARVFESEEQCLSAVRAMAYAAGDVIVIRNEGPRGGPGMREMLGITALLYGQGMGEKVALITDGRFSGATRGMCIGYISPEAASDGPIGLVRDGDLIAIDARDGIVSLQVELPKGELEARRALPRPARVRPKGGVLEKYAAIVGPANKGAVTHSGNVIWEMDP

SEQ ID NO: 113 - DNA, 1767 bp, Burkholderia xenovorans
atgaccaatctgcataaacaccgctcccgcatggtgaccgatggtgtgacgcgtgcgccgcaccgtgcctttctgcgcgcgacaggcctcgacgatgcgtcgatgcaaaagccgttcgtcgcgatcgtcgatacgtttggcgagaacacgccgtgttcgatgtcgctgaaccaggtgtccgataacgcacgtctcggcgttgccgctggcggcggcataccgattcgcggctcggcgatctcggtgtcggacggtacctcgatgaatcattcggggatgcgcatgagccttgtatcgcgcgagatcgtcgcggacagcgtcgagctgttcgtgcgtgcccatgcctacgatgcgctgatcggcgtggccggctgcgacaagacgctgcccggcatcctgatgggcatggttcgcgtcaacgtgcccggcgcgttcctgttcggcggcgcgatgctgccgggcgtggcgcccgggcagatccccggcggaggcggcacgggccagcaacgccaggcaacgatcctcacgaccatcgaagcggtgggcaccgcgcagcgcggcgacatcacccgcgcgcagctcgacgccatcgaaaagcagtgcacgccgaccgccggctcatgtcccggccagttcaccgcgaacaccatggcgatggtcgcggaagcgctgggactcgccccgctcggctcggcgatggtgccggccgtctatagcgaacgcattgcgattgcgcggcgcgctggcgaaacggtgatgcgcacgctcaaggaaggcgccccgctgccacgcgatctggttacgctgaaaagcctggagaatgcctgcgccgccgttgccgcgacgggcggctcgaccaacgccgcgctgcacattccggcgatcgcgcatgaagccggcatccgcttcacgctcgacgacgtgcagcgcgtgttcgcgcgcattccgctgatcggcgacctgcagcccggcggccgctatctcgcgcaggacctgcatcatgcgggcggcgtgccggcggtgctcaacgcgttgctggccggtggctatctgcatggcgacgccctcacgctcgacggcctcacgctggaagacgcgttgcgcggctacgccggtcccgatggcacggtggtgcgttcatgcgatgaaccgctcggcgagaacggcggcctcgtgatcctgcgcggcaatctcgcaccggacggtgcgtgcctgaaaatcgccgggctcaaagcgctgaccttctcaggtaagacgcgcatcttcgaatgcgaggaagactgcatggcggtggtcgctgcacgcgattatcgcgaaggcgacgtcctcgtgatccgcaacgaagggccgaagggcggtcccggcatgcgggagatgctcagcgtgaccgcggcgatctacggacaaggcatgggcgagaaagtcgcgctgctgaccgatggacgcttttcgggggcgacgcgcggcatgtgtatcggttatgtcggaccggaagcggcggtgggcggtccgattgcgctgctgcgcgatggtgatcgggtgcagatcgatgcgcgcgcgggaacgctgcgcgtcgagctatccgacgacgaactcgcgcgacgccgtgcggatctgccggcgaggccaaggcgccggctcgccggcgtgctggagaagtacgaggcgctggtgcggcctgcgcatctcggggcggtcacgcattcgggcaatctcgattggccctacgatgcgccgacgcatggcgacgacggagccgccgcgtga

SEQ ID NO: 114 - protein, 588 aa, Burkholderia xenovorans
MTNLHKHRSRMVTDGVTRAPHRAFLRATGLDDASMQKPFVAIVDTFGENTPCSMSLNQVSDNARLGVAAGGGIPIRGSAISVSDGTSMNHSGMRMSLVSREIVADSVELFVRAHAYDALIGVAGCDKTLPGILMGMVRVNVPGAFLFGGAMLPGVAPGQIPGGGGTGQQRQATILTTIEAVGTAQRGDITRAQLDAIEKQCTPTAGSCPGQFTANTMAMVAEALGLAPLGSAMVPAVYSERIAIARRAGETVMRTLKEGAPLPRDLVTLKSLENACAAVAATGGSTNAALHIPAIAHEAGIRFTLDDVQRVFARIPLIGDLQPGGRYLAQDLHHAGGVPAVLNALLAGGYLHGDALTLDGLTLEDALRGYAGPDGTVVRSCDEPLGENGGLVILRGNLAPDGACLKIAGLKALTFSGKTRIFECEEDCMAVVAARDYREGDVLVIRNEGPKGGPGMREMLSVTAAIYGQGMGEKVALLTDGRFSGATRGMCIGYVGPEAAVGGPIALLRDGDRVQIDARAGTLRVELSDDELARRRADLPARPRRRLAGVLEKYEALVRPAHLGAVTHSGNLDWPYDAPTHGDDGAAA

SEQ ID NO: 115 - DNA, 1767 bp, Burkholderia phytofirmans
atgaccaatctgcacaaacatcgctcgcgcagggtgaccgacggcgtcacccgcgcgccgcatcgcgcgttccttcgcgctaccggcctcgacgacgaatccatgcaaaagccgttcgtcgcgatcgtcgatacgttcggcgagaacaccccgtgttcgatgtcgctgaaccaggtctccgacaacgtgcgcctcggcattgcagcgggcggtggcgtgccgatccgcggctcggcgatctcggtgtcggacggcacgtcgatgaatcactccggcatgaggatgagcctcgtgtcgcgcgaagtggtcgcggacagcgtcgaactgttcgtgcgtgcgcataactacgacgcactgatcggcgtcgccggttgcgacaagaccttgcccggcatcctgatgggcatggtgcgcgtcaacgtgcccggtgtgttcctgttcggcggcgcaatgctgcccggcgtcgcacccggtcagttgcccggcggcgccggcaccggcctgcaacgccagtcgacgattctcacgacaatcgaagcggtcggcaccacgcagcgtggcgacatgagccgcgcgcaacttgacgccatcgaaaaacaatgcacgccgactgccggatcgtgtcccggccagttcaccgcgaataccatggcgatggtcgcggaaacgcttggcctcgcgccgctgggctccgcgatggtgcccgccgtctacagcgaacggattgcgattgcgcgccgcgccggcgagacagtcatgcgtatcctgacgcaaggcgggcccttgccgcgcgatctcgttacgatggaaagcctggagaacgcctgcgcggcagttgccgcgaccggcggttcgaccaatgccgcgctgcacattccggccatcgcgaacgaggccggcattcgcttcgcgctggacgacgtgcaacgcgtgttcgcgaaaattccgctgatcggcgatctgcaaccaggcggccgctatctcgcgcaggatctgcatcacgcgggcggcgtgccggccgtgttgaacgcgctgctggcaggcggcttcctgcatggcgatgtgcccgcgttcggcggcggcacgctcgccgaagcattgagcgcgttcagcggaccggacggcatcgtcgtgcgtccgtgcgacgagccgctcggcgaaaacggcggactcgtgatcctgcgtggcaacctcgcgccggacggcgcatgtctgaaaatcgccgggctcaaatcgctttcgttcacgggcgcggtgcgtgtattcgaatgcgaagaagactgcatggcggttgtcgcggcgcgcgactaccgcgaaggcgacgtgctcgtgatccgtaacgaagggccgaaaggcggtcccggtatgcgcgaaatgctgggtgtgacagcagcgatctacggtcagggcatgggcgagaaagtggcgttgttgaccgacggtcggttttcgggcgcgacacgtggcatgtgcatcggctatgtcggcccggaagcggcggcgggtggcccgatcggcctgttgcgcaatgacgaccgcgtgcatatcgacgcgcgcgcaggcattctgcgcgtcgacctgtccgacgacgaactcgcccgtcgccgcgccgacgcgccagcgcgcgcgtcgcgccggctcgcgggggtgctcgaaaaatacgaagcgttggtgcggcccgcgcatctcggcgcggtgacgcattcgggcaacgttgaatggccatacgacgaacccacgcccggcgacgacggagccgccgcatga

SEQ ID NO: 116 - protein, 588 aa, Burkholderia phytofirmans
MTNLHKHRSRRVTDGVTRAPHRAFLRATGLDDESMQKPFVAIVDTFGENTPCSMSLNQVSDNVRLGIAAGGGVPIRGSAISVSDGTSMNHSGMRMSLVSREVVADSVELFVRAHNYDALIGVAGCDKTLPGILMGMVRVNVPGVFLFGGAMLPGVAPGQLPGGAGTGLQRQSTILTTIEAVGTTQRGDMSRAQLDAIEKQCTPTAGSCPGQFTANTMAMVAETLGLAPLGSAMVPAVYSERIAIARRAGETVMRILTQGGPLPRDLVTMESLENACAAVAATGGSTNAALHIPAIANEAGIRFALDDVQRVFAKIPLIGDLQPGGRYLAQDLHHAGGVPAVLNALLAGGFLHGDVPAFGGGTLAEALSAFSGPDGIVVRPCDEPLGENGGLVILRGNLAPDGACLKIAGLKSLSFTGAVRVFECEEDCMAVVAARDYREGDVLVIRNEGPKGGPGMREMLGVTAAIYGQGMGEKVALLTDGRFSGATRGMCIGYVGPEAAAGGPIGLLRNDDRVHIDARAGILRVDLSDDELARRRADAPARASRRLAGVLEKYEALVRPAHLGAVTHSGNVEWPYDEPTPGDDGAAA

SEQ ID NO: 117 - DNA, 1713 bp, Bordetella petrii
atgtcactgcacaaacaccgctcgcggatggtcaccgacggcctgacccgggcgcctcaccgggcctttctgcgcgccaccgggttcgacgacgaagccctgaagaaatcaatcgttggcattgtcagtacccaaggcgaaaacacgccctgctcgatggccctggcgccccaggcggaccgcgcccgcctgggcgtggcggccgggggcggcgtgccggtcagtttttcgaccatttcggtgtcggatggcacgtccatgaaccatgccggcatgcgcatgagcctgctttcgcgcgaggcgatcgccgacagcgtggaaatggtgatgcgcggccacgcctatgacggactggtggcgttcgccggctgcgacaagacgctgcccgccatgatgatggcgatcgtgcgcctgaacgtgccggcggtgtttctctacggcggcgcgacgttgcccggccacgcgctcggcaagcaggccaccatcctggacaccatcgaggcagtgggccgcgtgcagcatggcggcatgacggccgccgagctcaagaccatggagcgtacttgcacgccatcggccggctcgtgcccgggccaattcaccgccaacaccatggccatggtcggagaagccctgggcttgtcgcccctgggcaccgccatgatgcccgcggtgtacagcgaacgcctggccatcgcccagcgggccggcgaacaagtcatgcgcgccctggcccaaggcggccccctgccgcgcgacctggtcacgcgcgccagcctggacaatgcctgcgccgcggtggctgccaccggcggctcgaccaacgcggcgctgcacattcccgccatcgctcacgaagccggcatccgctacacgctggatgacgttgccgccgtattccagcgcacgccattgatcgcggacttgcagccgggcggacgcttcctggcgcgcgacctgcacgaagcgggcggcgtgcccgccgtactgaaagccctgctggaaggcggttatatcgacggcaacgtgccgacgctcgacggccggccgctggcgcgagccctggtcgacttcgccgggccggacggcgaggtggtgcgcccctgctcgcgcgcgatccacccttcgggcggcgtcacggtgctgaaaggcaacctcagcccgcaaggcgcgctgctcaagatcgcgggcctgaaatcgctgcaattctccgggccggcgcgcgtgttcgaaaacgaagaagactgcatgcgcgcggtgtcacagcgcacctaccagcccggcgacgtgctggtcatccgcaacgaaggcccccagggcgggccgggcatgagagagatgctcagcgtgaccgccgcactgtatggacagggcatgggcgaaaaagtggccctgctgaccgacggccgcttctcgggcgcgacgcgcgggctgtgcatcggttatgtgggccccgaggccgcggcgggcggccccatcgccttcgttcgcgacggcgacatcatccatatcgacgcccaggccaataccttgcgcgtcgaactcagcgacgccgaactggccgcccgccgcgccagccatgtgccgccggcacggccgcgcctggccggcgcgctcgaaaaatacgccttgctggtgcggccggcgcacgaaggcgccgtcacgcactcggggggattggattggccctacgaaaccccggaggccgaatga

SEQ ID NO: 118 - protein, 570 aa, Bordetella petrii
MSLHKHRSRMVTDGLTRAPHRAFLRATGFDDEALKKSIVGIVSTQGENTPCSMALAPQADRARLGVAAGGGVPVSFSTISVSDGTSMNHAGMRMSLLSREAIADSVEMVMRGHAYDGLVAFAGCDKTLPAMMMAIVRLNVPAVFLYGGATLPGHALGKQATILDTIEAVGRVQHGGMTAAELKTMERTCTPSAGSCPGQFTANTMAMVGEALGLSPLGTAMMPAVYSERLAIAQRAGEQVMRALAQGGPLPRDLVTRASLDNACAAVAATGGSTNAALHIPAIAHEAGIRYTLDDVAAVFQRTPLIADLQPGGRFLARDLHEAGGVPAVLKALLEGGYIDGNVPTLDGRPLARALVDFAGPDGEVVRPCSRAIHPSGGVTVLKGNLSPQGALLKIAGLKSLQFSGPARVFENEEDCMRAVSQRTYQPGDVLVIRNEGPQGGPGMREMLSVTAALYGQGMGEKVALLTDGRFSGATRGLCIGYVGPEAAAGGPIAFVRDGDIIHIDAQANTLRVELSDAELAARRASHVPPARPRLAGALEKYALLVRPAHEGAVTHSGGLDWPYETPEAE

SEQ ID NO: 119 - DNA, 1713 bp, Bordetella bronchiseptica
atgtccctgcataagcaccgttcccgcatggttacccaaggcctgacgcgcaccccgcatcgcgccttcctgcgcgccaccggcttcgacgacgccgccctggagaaatccatggtcggcatcgtgagcacgcaaggcgagaacacgccctgctccatggcgctggggccgcaggccgaccgcgcccgcctgggcgtggccgccggcggcggcgtgccggtcagcttctcgaccatctcgatctccgacggcacctcgatgaaccatgcgggcatgcgcatgagcctgctgtcgcgcgagaccatcgccgacagcgtcgagctggtggtgcgcggccacgcctatgacgcactggtggcgttcgccggctgcgacaagacgctgccggccatgatgatggccatcgtgcggctgaacgtgccggcggtgttcctgtacggcggcgccaccctgcccggccatgcggccagcggccaggtcaccatcctcgacaccatcgaagccgtcggccgggtacagcacggcaccatgccggcggccgagctcaaggcgatggagcgcacctgtacgccctcggcgggctcgtgcccgggccagttcaccgccaacaccatggccatggtgggcgaggcgctgggcctgtcgccgctgggttcggcgatgatgcccgcggtctacagcgaacggctggccatcgcgcagcgcgccggcgagcacgtgatgcgcgccctggccgcgggcggcccgctgccgcgccagctggtgacgcgcgccagcctggagaacgcctgcgccgcggtggcggccaccggcggctcgaccaacgcggccctgcacattccggccatcgcgcacgaggccggcatcgccttcacgctggacgacgtggcccgggtgttcaagcgcacgccgctgatcgccgacctgcaacccggcggccgctatctggcgcgcgacctgcacgaggccggcggcgtgccggtggtgctcaaggcgctgctggacggcggccatatcgacggcagcgtgctgacgctcgacggccgcaccctggccgaggccctggccgacacgcccgcgcccgacggcaaggtggtgcgcgcctgcggccaggccctgcaccccaccggcggcgtcgccgtgctcaagggcaatctcagccccgatggcgcgctgctgaagatcgccggcctgaagtcgctgaaattctccgggccggcgcgcgtgttcgagaacgaggaagcctgcatgcgcgcggtgtccacgcacgcctaccagccgggcgaagtcctggtcatccgcaacgaaggcccccggggcgggccgggcatgcgcgagatgctcagcgtcacggccgccctgtatggacagggcatgggcgagaaagtggcgctgctgaccgacggccgcttctcgggcgccacgcgcggcctgtgcatcggctacgccgggccggaagcggccgccggcggccccatcgcgctgctgcgcgatggcgacatgatccacatcgacgccgaggccgatacgctggacgtggcgctgtccgacgaagagctggcgcggcgccgcgccgcctaccaggcgccgccgcaggcgcgcctggccggcgcgctggagaaatacgccgcgctggtgcgcccggcctgcctgggcgcggtcacccactccggccaggtcgattggccttacgaaacgccggaggccgaatga

SEQ ID NO: 120 - protein, 570 aa, Bordetella bronchiseptica
MSLHKHRSRMVTQGLTRTPHRAFLRATGFDDAALEKSMVGIVSTQGENTPCSMALGPQADRARLGVAAGGGVPVSFSTISISDGTSMNHAGMRMSLLSRETIADSVELVVRGHAYDALVAFAGCDKTLPAMMMAIVRLNVPAVFLYGGATLPGHAASGQVTILDTIEAVGRVQHGTMPAAELKAMERTCTPSAGSCPGQFTANTMAMVGEALGLSPLGSAMMPAVYSERLAIAQRAGEHVMRALAAGGPLPRQLVTRASLENACAAVAATGGSTNAALHIPAIAHEAGIAFTLDDVARVFKRTPLIADLQPGGRYLARDLHEAGGVPVVLKALLDGGHIDGSVLTLDGRTLAEALADTPAPDGKVVRACGQALHPTGGVAVLKGNLSPDGALLKIAGLKSLKFSGPARVFENEEACMRAVSTHAYQPGEVLVIRNEGPRGGPGMREMLSVTAALYGQGMGEKVALLTDGRFSGATRGLCIGYAGPEAAAGGPIALLRDGDMIHIDAEADTLDVALSDEELARRRAAYQAPPQARLAGALEKYAALVRPACLGAVTHSGQVDWPYETPEAE

SEQ ID NO: 121 - DNA, 1707 bp, Bradyrhizobium sp.
atgaggaagctgcgttcgcgcgtgacggtggaggggctcgaccgcgccccgcaccgcgccttcatgcgcgcgatgggcctcgatgacgccgacatcgccaagccgatgatcggaatcgtcagtcagaggggcgagcagacgccctgcaacatgacgcacgacttccaggtcgatgccgccaagaccggcatctccgagtccggcggcacgccgcgcgaattcgccaccgtctccgtctccgacggcatcagcatgaaccatgagggaatgaagttctctctgttctcccgcgagctgatcgccgattcgatcgaggccgtggtgcacggcctagcctatgacgcgctgatcggcttcggcggctgcgacaagaccttgcccggcgtgatgatgggtatggtccgctgcaacgtgccgtcgatcttcatctatggcggcagcgcgctgcccggcaagtaccagggcaagacgctcacggtgctcgactcctacgaagcggtcggcagctacatgaccggcgagatcgatgccgccacgctcgaaggcatcgagcgctcgtgcctgccgacgatcggcgcctgcgccggccagttcaccgcgaacaccatgggcatgctgtctgaggcgatgggcctgtcgatgcccaacgtctcgatgatccccggcgtctatgccgagcgcgcccatgtcgcgcgcgcagccgggcgcctgatcatgcagatgctcgccaacgatggcccgcggccgcgcgacatcgtcacccgcaaatccctggagaacggcgcggcgatcgtcgccgccaccggcggctcgaccaacgcggccctgcatctgcctgcgatcgcgaacgaggccggcatccgcttcacgctcgacgatgtcggcgaggtgttttcgcgcacgccgctgatcggcaatctcaggcccggcggcaagtatacggcgaaggacgtgtatgacatcggcggcgcggccgtcgtgatccgcgcgctgatcgacagcggccacatcgacggctcctgcatcacggtgaccggccgtacgctcgccgaggcctgcggcgcggccaatgcgccggatggcgaggtcgtgttcacgccggccaggccgatgatggccgacggcggcgtcgccgtgctcaagggcaatctcgcgccggatggtgcggtcatcaaggtcgccggtctcaagagcctggtgttcgagggccgcgcgcgcgtgtttgaagatgaagaagcctgcgtcgccgccgtccgcgcccgcaactaccaggcgggcgaggtgctgatcatccgtaacgaggggccggtcggcggccccggcatgcgcgagatgctcggcgtcaccgcgctgatctatggccagggcatgggcgagaaggtcgcgctgatcaccgacggccgcttctccggtgccacccgcggtttatgcatcggctacgtctcgccggaagccttcgtcggcggcccgctggcgctggtgcgtgatggcgatcccattcgcatcgatgcgaaagcgcgcacgctcgacgtgctgctcgacgagggcgagctcgccgcgcgtcgcagcgcgtggacgcagcggccgccgcggcatcgcgcgggagcgctggcgaaatacgcgaaactggtggggcaggcgccgctcggcgcggtcacgcatgagggaccggcggaatggccctggttcgatcaggagcaggaatga

SEQ ID NO: 122 - protein, 568 aa, Bradyrhizobium sp.
MRKLRSRVTVEGLDRAPHRAFMRAMGLDDADIAKPMIGIVSQRGEQTPCNMTHDFQVDAAKTGISESGGTPREFATVSVSDGISMNHEGMKFSLFSRELIADSIEAVVHGLAYDALIGFGGCDKTLPGVMMGMVRCNVPSIFIYGGSALPGKYQGKTLTVLDSYEAVGSYMTGEIDAATLEGIERSCLPTIGACAGQFTANTMGMLSEAMGLSMPNVSMIPGVYAERAHVARAAGRLIMQMLANDGPRPRDIVTRKSLENGAAIVAATGGSTNAALHLPAIANEAGIRFTLDDVGEVFSRTPLIGNLRPGGKYTAKDVYDIGGAAVVIRALIDSGHIDGSCITVTGRTLAEACGAANAPDGEVVFTPARPMMADGGVAVLKGNLAPDGAVIKVAGLKSLVFEGRARVFEDEEACVAAVRARNYQAGEVLIIRNEGPVGGPGMREMLGVTALIYGQGMGEKVALITDGRFSGATRGLCIGYVSPEAFVGGPLALVRDGDPIRIDAKARTLDVLLDEGELAARRSAWTQRPPRHRAGALAKYAKLVGQAPLGAVTHEGPAEWPWFDQEQE

SEQ ID NO: 123 - DNA, 1707 bp, Bradyrhizobium sp.
atgaggaagctgcgctcgcgcgtcacggtggaggggctcgatcgtgccccgcaccgcgccttcatgcgcgcgatggggctggatgatgccgacatcgccaagccgatgatcggcatcgtcagccagaagggcgagcagacgccctgcaacatgacgcacgacttccaggtcgacgccgccaagacgggcgtctccgaagccggtgggacgccgcgcgaattcgccaccatctcggtgtcggacggcatcagcatgaaccatgagggaatgaagttctctctgttctcgcgcgaactgatcgcggattcgatcgaggccgtggtccatggtctcgcttatgacgcgctgatcggctttggcggctgcgataagaccctgccgggcgtcatgatgggcatggttcgttgcaacgtgccgtcgatcttcatttatggcggcagcgctctgcctggcaagttccagggcaagacgctcacggtgctcgattcgtatgaagcggtcggcagctacatgaccggcgagatcgatgtcgcgacgctcgagggcatcgagcggtcgtgcctgcccaccatcggcgcctgcgccgggcagttcaccgccaacaccatgggcatgctgtccgaggcgatgggcctgtcgatgcccaacgtctcgatgatccccggcgtctatgccgagcgcgcccatgtcgcgcggcaggccggccggctgatcatgcagatgctggctcgtggtgggccgctgccacgcgatatcgtgacccgcaaggccctggagaacggtgcggcgatcgtcgccgccaccggcggctcgaccaatgccgcgctgcatctgccggcgatcgccaacgaagccggcatccgtttcacgctcgacgatgtcggcgaggtcttcgcccgcacgccgctgatcggcaatctccggccgggcgggaagtacaccgccaaggacgtctatgacatcggcggcgcggccgttgtgatccgcgcgctgatcgagagcggccatatcgacggctcctgcatgacggtgaccggccgcacgcttgccgaggactatggggccgccaatgcgcccgatggcgagatcgtgtttcatccggccagcccgatcatggcggagggcggcgtcgccgtgctcaagggcaatctggcgcctgacggcgcggtcatcaaggtggccggcctgaagaacctcgtattcgaggggcgggcccgcgtattcgaggatgaggaagcctgcgtcgccgccgtccgcgcgcgcaactatcaggcgggcgaggtactgatcatccgcaacgaggggccggtcggcggtcccggcatgcgcgaaatgctcggtgtgaccgcactgatctacggtcagggcatgggcgagaaggtggcgctgatcaccgacggccgcttctccggagcgacgcgcggcatgtgcattggctatgtctcgccggaagccttcgtcggcggtccgttggcgctgctgcgcgacggcgatccgattcgcatcgatgcaaaagcgcgcacgctcgacgtcctgctcgacgacgccgagctcgcggcccgtcgcgccgcgtggtcgcagcggccgccacggcatcgcgccggcgcgctggcgaaatatgccaagctcgtcggccaggcaccgctcggcgccgtgacgcatgaaggacccgcggactggccgtggttcgatcaggagcagaaatga

SEQ ID NO: 124 - protein, 568 aa, Bradyrhizobium sp.
MRKLRSRVTVEGLDRAPHRAFMRAMGLDDADIAKPMIGIVSQKGEQTPCNMTHDFQVDAAKTGVSEAGGTPREFATISVSDGISMNHEGMKFSLFSRELIADSIEAVVHGLAYDALIGFGGCDKTLPGVMMGMVRCNVPSIFIYGGSALPGKFQGKTLTVLDSYEAVGSYMTGEIDVATLEGIERSCLPTIGACAGQFTANTMGMLSEAMGLSMPNVSMIPGVYAERAHVARQAGRLIMQMLARGGPLPRDIVTRKALENGAAIVAATGGSTNAALHLPAIANEAGIRFTLDDVGEVFARTPLIGNLRPGGKYTAKDVYDIGGAAVVIRALIESGHIDGSCMTVTGRTLAEDYGAANAPDGEIVFHPASPIMAEGGVAVLKGNLAPDGAVIKVAGLKNLVFEGRARVFEDEEACVAAVRARNYQAGEVLIIRNEGPVGGPGMREMLGVTALIYGQGMGEKVALITDGRFSGATRGMCIGYVSPEAFVGGPLALLRDGDPIRIDAKARTLDVLLDDAELAARRAAWSQRPPRHRAGALAKYAKLVGQAPLGAVTHEGPADWPWFDQEQK

SEQ ID NO: 125 - DNA, 1749 bp, Bradyrhizobium japonicum
atgaagttgcgatgtcccgccgcgtacgggacatcgcacgtagatgatgcaaatatgaagaagttgcgatcacggataacgacagacggcctcgaccgggccccgcaccgcgcattcatgcgcgcaatggggctggacgatgcggcaatcgccaagcccatggtaggcattgtcagcatgaagggcgagcagacgccctgcaacatgacccacgacttccaggtggccgcggccaagacaggtattgaggaggccggcggcacgccgcgcgaattctcgaccgtgtcggtctctgacgggatcagcatgaatcacgagggaatgaagttctccctcttttcgcgcgagctgatcgccgactcgatcgaggctgtcgttcatggtctcgcctatgacgcgttgatcggatacggcggatgcgacaagacgcttcccggcgtgatgatgggcatggttcgttgcaacgtgccgtcgattttcatctacggcggcagttcgctgccggggcgcgtggacggacgaacgctgacagtgctcgactcctacgaggctgtcggcagcttcatgaccggagagatcgatagcgccacactggagcggatcgagcgcgcctgcctgccgaccatcggtgcgtgcgcgggccagtttactgcgaacaccatgggaatggtgtcggaggcgatggggctcaccattcccaacgtctcgatggtgcccggtgtctacgccgagcgcgcgcagatctcgcgacgcgccgggcggctgatcatggaaatgctggaacgcggtgggccgctgccacgggacatcgtgacgcggaaatccctcgagaacggggcggcgatcgtcgccgctacgggcggctcgaccaacgccgcgctgcatctgcccgccatcgcgaacgaggccggcatcgcattcacgatcgacgatgtcggcgaggtctttgccaggacgccgctgatcggaaatctgcggcccggaggcaaatacacggcgaaggatgtccacgacataggtggcgccgccgtggtgatccaggagttgatcagaaccggtcatatcgacggtaactgcatcaccatcaccggccggacgcttgccgaagaatatggcgcggccaacgcgccggacggtgaggtcgtttacgcggcaagtgcgccgatcatgccggatggcggtgtcgcggtgctgaagggcaacctctgtccggacggtgcggtcatcaaggtcgcaggtttgaagagccagttcttcgagggtgtcgcgcgcgttttcgaagacgaggaggcttgcgtcgcagcggttcgcgaccgcagctacaaggcaggtgaggtcctggtgatccgcaacgaagggccggtcggcggccccggtatgcgcgagatgctcggcgtcaccgcgctgatctacgggcagggcatgggcgaaaaggtggccctgatcaccgacgggcggttctccggcgcgacccgcggcatgtgtatcggctacgtgtcccccgaagcattcgttggcggtccgttggccctcgttcgcgacggcgacaagatccggattgatgctacaaaccggcgtatggatatgctggtcgacgagccggagctcgcggcgcgccgacgtgattggaaaccacgcccgccgcgtcaccgcgcaggcgcgctcgcaaaatatgcgcgactggtcggccaggcgccgggcggagcggttacccatgaggggcccgcagaatggccctggttcgaatga

SEQ ID NO: 126 - protein, 582 aa, Bradyrhizobium japonicum
MKLRCPAAYGTSHVDDANMKKLRSRITTDGLDRAPHRAFMRAMGLDDAAIAKPMVGIVSMKGEQTPCNMTHDFQVAAAKTGIEEAGGTPREFSTVSVSDGISMNHEGMKFSLFSRELIADSIEAVVHGLAYDALIGYGGCDKTLPGVMMGMVRCNVPSIFIYGGSSLPGRVDGRTLTVLDSYEAVGSFMTGEIDSATLERIERACLPTIGACAGQFTANTMGMVSEAMGLTIPNVSMVPGVYAERAQISRRAGRLIMEMLERGGPLPRDIVTRKSLENGAAIVAATGGSTNAALHLPAIANEAGIAFTIDDVGEVFARTPLIGNLRPGGKYTAKDVHDIGGAAVVIQELIRTGHIDGNCITITGRTLAEEYGAANAPDGEVVYAASAPIMPDGGVAVLKGNLCPDGAVIKVAGLKSQFFEGVARVFEDEEACVAAVRDRSYKAGEVLVIRNEGPVGGPGMREMLGVTALIYGQGMGEKVALITDGRFSGATRGMCIGYVSPEAFVGGPLALVRDGDKIRIDATNRRMDMLVDEPELAARRRDWKPRPPRHRAGALAKYARLVGQAPGGAVTHEGPAEWPWFE

SEQ ID NO: 127 - DNA, 1686 bp, Sphingomonas wittichii
atggcgttgaaggacgggaagggcgagacgcttccctcgcggacgatcaccgacgggctcgaccgcgccccgcaccgcgccttcctgcgggcgatggggcatgacgacgtggcgatcggccagcccttcgcgggcatcgtctcgaccggggcgtcggtgacgccctgctcgatgtcgctggcgcctcaggccgaggcggcgaaggccgggctccaggcggcgggggtgacgccgttcgaattctcgacgatcaccgtcgccgacagcatgtcgatgaaccatgccgggatgcgtttcagcctggtctcgcgggagatcatcgccgattcgatcgaggcggtgacgcgggcgcatggctatgacgggctgatcggcttcgcggcctgcgacaagacgttgccgggcacgatgatggggatgatccgggtcaaccgcccgtcggtgttcgtctatggcggcgcggcgctgcccggccgctggcaggggcgcgacatcggcatcgtcgacgtctatgagggcgtcggccgggtctatgccggcgagatggacgaggccgagctgacgcgcctcgaaaaggcgggggtgccgaccgtcggctcctgcgccgggcagttcaccgccaacaccatggcgatggtcgccgagacgctgggcctggcgctgccgcgcagcgcgatgatgccggcggtggcgagcgagcgccgcgcgctggccgaggaatcgggccgcgtgctcggccggctgatccgcgagggcggcccgcgcccgcgcgacctcgtcacccgtcgcagcctcgaaaacgccgccgccaccgttgccgccaccggcggctcgaccaacgccgcgctgcacctgccggcgatcgcacatgaggcaggcatatccttcaccatggaggacatcgccgcgatcttcgaccgcaccccgctgctcgccgacctcaagcccggcggccgcttctgggcgcgcgacctgcacgaggtcggcggcgtgccgaccgtgctgcgggcgatgctggaggcgggcgtgctgcacggcgactgcccgaccatcaccggccggacgatcggcgagatcgccgccgccgcgcccgcgccggacggggaggtggtgcgccccgccgaccggccgatcgcgccgaccggcggggtgatcgtgctgcgcggcagcctcgcccccgacggcgcgatgctcaaggtcgccgggctcaagcgcctgtcgcacgaagggccggcgcgggtgttcgacggcgaggaggcggcggtcgacgcggtccgccggcaggattaccagccgggcgacgtcatcgtcatccgtggcgaggggccgaagggcggccccggcatgcgtgagatgctgggcgtcaccgcgctgatctacggccagggcatgggcgaacaggtcgcgctgctcaccgacggccgcttctcgggcgcgacgcgcggcatgtgcatcggccatgtcggcccggaggcctcggccggcggcccgctcgcgctggtccgggacggcgatcgcatccgcatcgacgcgggccagcgcacgctcgacctgctcgtcgatgccgccgagctggagcgccgccgcgcggcctggaccgcgccggaggctaccgtcacctcgccgaccttgcgcaaatatgcgcggctcgtcgggccggcgcatctcggcgccgtcacccactga

SEQ ID NO: 128 - protein, 561 aa, Sphingomonas wittichii
MALKDGKGETLPSRTITDGLDRAPHRAFLRAMGHDDVAIGQPFAGIVSTGASVTPCSMSLAPQAEAAKAGLQAAGVTPFEFSTITVADSMSMNHAGMRFSLVSREIIADSIEAVTRAHGYDGLIGFAACDKTLPGTMMGMIRVNRPSVFVYGGAALPGRWQGRDIGIVDVYEGVGRVYAGEMDEAELTRLEKAGVPTVGSCAGQFTANTMAMVAETLGLALPRSAMMPAVASERRALAEESGRVLGRLIREGGPRPRDLVTRRSLENAAATVAATGGSTNAALHLPAIAHEAGISFTMEDIAAIFDRTPLLADLKPGGRFWARDLHEVGGVPTVLRAMLEAGVLHGDCPTITGRTIGEIAAAAPAPDGEVVRPADRPIAPTGGVIVLRGSLAPDGAMLKVAGLKRLSHEGPARVFDGEEAAVDAVRRQDYQPGDVIVIRGEGPKGGPGMREMLGVTALIYGQGMGEQVALLTDGRFSGATRGMCIGHVGPEASAGGPLALVRDGDRIRIDAGQRTLDLLVDAAELERRRAAWTAPEATVTSPTLRKYARLVGPAHLGAVTH

SEQ ID NO: 129 - DNA, 1683 bp, Rhodobacterales bacterium
atgaccaaacgcgacacgctcatctcacgcaccatcgtggaggggctcgaccgtgcgccccaccgcgccttcctgcgcgcgatggggcacgacgacacggcactggccagcccgttcgtcggcatcgcacataccgcgagcgaggtgacgccctgcaccatgtcgctcccgccgcagatccagtcggccaagttaggcatcacccgcgaaggaatgaccccgttcgaattcggcacgatcaccgtggccgacagcatgtcgatgaaccatcgcgggatgcgcttttcgctcgtctcgcgtgagatcatcgcggacagcatcgacgcagtggtgcgcggccatgcctatgacgggctgatgaccttcgcctcctgcgacaagacgctgccgggcatgttgatggccatcgcgcgcatcaaccgcccttcggtctttctgtatggcggggccgcgctgccgacgccgtggaacgggcaggacatcggggtggtcgacgtctacgaaggcgtggggcgcgtctatgaggggacatcgagcgaggaagagctcgacgcgatggaacgggtgggcgtgcccactgtcggctcctgcgccgggcagttcacggccaacaccatggcgctcgtggccgaggttctgggcttggcccccctcggtgtcgcctaccttcccgccgtctattccgaacggcaggcactggtgaaacgcgcggcgggtctgttgcgccgcgcggtggacgagaacggcccgctgccctcggacctcatcacgcgcgagtcgctggaaaacgccgtggtcgctgtgggcgcgacgggcgggtcgaccaatgccctcctgcacctgcccgcaatcgcgaacgaggtcgggatcagcttcacgctggacgacatcgcgaaggtgcttgaggacgtgccgctggtcgccgacctgaaacccggcggcgcctactgggcgcgcgacatgcaccacgtgggcagcaccccggcgctcctgcgcgtgttgaagggggcgggcgtgctgcacacggacacgccgagtgtcgagggccggacgctgggtgaactggccgacaccggacctgaagcggacggcaaggtgatccgagccgtgggcaatccggtcacgccgacctcaggcgtggtggtgctcaaggggtcgctcgcccccgaaggggcggtgctcaaggtcgcgggtctcaagcacacagttcacgaaggccccgcgcgggtgttcgagtgcgaggaggatgccgtggccgccgtgcgcaagcgcgaatacgaggcgggcgacgtgattgtgatccgcaacgaaggccccaagggcgggccggggatgcgcgagatgctgggcgtcaccgcgctcctctacggtcagggcatgggcgagaaggtcgcgctcatcaccgacggccgcttctcaggcgcgacgcggggtctgtgcatcggtcacgtcgggcccgaggcggcggcgggtggtcccatcggcctgatccgcaccggcgacatcatccagatcgacgcgggcaaacgggagttgaacgtcaaactatcgacagacgagcttgcccggcgcacccgccccccggtgcccgaggggctggaacccgaaacggcgaccctgcgcaaatacgcggctctcgtcggccccgcgcatctgggcgcgaccacgcaccggaacacctag

SEQ ID NO: 130 - protein, 560 aa, Rhodobacterales bacterium
MTKRDTLISRTIVEGLDRAPHRAFLRAMGHDDTALASPFVGIAHTASEVTPCTMSLPPQIQSAKLGITREGMTPFEFGTITVADSMSMNHRGMRFSLVSREIIADSIDAVVRGHAYDGLMTFASCDKTLPGMLMAIARINRPSVFLYGGAALPTPWNGQDIGVVDVYEGVGRVYEGTSSEEELDAMERVGVPTVGSCAGQFTANTMALVAEVLGLAPLGVAYLPAVYSERQALVKRAAGLLRRAVDENGPLPSDLITRESLENAVVAVGATGGSTNALLHLPAIANEVGISFTLDDIAKVLEDVPLVADLKPGGAYWARDMHHVGSTPALLRVLKGAGVLHTDTPSVEGRTLGELADTGPEADGKVIRAVGNPVTPTSGVVVLKGSLAPEGAVLKVAGLKHTVHEGPARVFECEEDAVAAVRKREYEAGDVIVIRNEGPKGGPGMREMLGVTALLYGQGMGEKVALITDGRFSGATRGLCIGHVGPEAAAGGPIGLIRTGDIIQIDAGKRELNVKLSTDELARRTRPPVPEGLEPETATLRKYAALVGPAHLGATTHRNT

SEQ ID NO: 131 - DNA, 1665 bp, Solibacter usitatus
atgaaactgcagagccataccatcactcagggacgagatcgcgccccggcgcgcgccatgttgaaagcgatcgggtttaccgatgaagatctggccaagccgatcatcgggatcgccaacacctggatcgagaccatgccgtgcaattacaacctgcgtgagctggccggcaaagtgaaggagggcatccgcgccgccggcgggacgccgatggagttcaacaccatcgcgatcagcgacggcgtcaccatgggcacggaaggcatgaaggcctcgctgatcagccgtgaagtaatcgcggattccatcgagctgatggtgcgcggccacatgttcgatggcatcgtcgccatggtggcctgtgacaagaccattcccggcgccgcgatggcgctgctccgcctcaacgtcccgggcgtggtgctttatggcggcaccatcatgccgggccgcttcgagggtcacgacatcacgattcaggacgtgtttgaagccgtcggcgcgcacgcgcgcggcaagatcaccgacgcgcaattgctcgacatcgaagaccacgcctgccccggcgccggagcctgcggcggacagttcacggccaacaccatggccaccgtgatggagctgatcggactctccccgatgggcacggctgccgttccccaggtggacaagcgcaaagacgcagtggcgtaccgctgcggcgaggttattctgaacgccgtgcgcaagaacattctgccgcgcgatatttgcacccgcaaagccttcgagaatgcgattgcaggcgtcgccggaacggccgggtccaccaacgccgtgctgcacctgctggccatggcgcgcgaagccgaagtgccgctgaccatcgatgagtttgaaccggtgctggcgcggacgccggtcttcgtcgatatcaaacccggcggaaagtacatggccgcggacgtggataaggccggcggcattccggtgatcgccaaccgcctgctcgagggcggctacgtggatggctcggcgatcacgatcaccggacgcaccttcgccgaagaagcgaacgaggccaaggaagtcgccgggcagccggtgattcttccgctcgccaaagcgctcaagccgcgcggcggtatcgcgattcttcgcggctctctggcgcccgaaggctgcgtgatcaagctggcaggccacgagaagaaatcgcaccacggtccggcgcgcgtgttcgagcgtgaggaagaggccatggcggccgtgcaggaaggcaagattcgcgagaacgacgtggtagtgatccgctacgaaggtccgcgcggcggccccggcatgcgcgagatgctgggcgtcaccggagccattgtcggcgccggtctgagcgatagcgtagcgctcttgaccgatggccgcttcagcggcgccacgcacggtttcatgatcgcgcacgtggcacccgaggcctttaacggcggcccgatcgcggtcgttcaggaaggcgacatgatcacggtggacgcaacccgcggcgtgcttgaattggatattcccgccggggaactgaagagccggctggccgcatggaagccccgcgaaccccgttacaagaaaggcgtgatcgcgaagtactgcaagctggtttcaagcgcgagcgaaggcgcgatcactcaagcatga

SEQ ID NO: 132 - protein, 554 aa, Solibacter usitatus
MKLQSHTITQGRDRAPARAMLKAIGFTDEDLAKPIIGIANTWIETMPCNYNLRELAGKVKEGIRAAGGTPMEFNTIAISDGVTMGTEGMKASLISREVIADSIELMVRGHMFDGIVAMVACDKTIPGAAMALLRLNVPGVVLYGGTIMPGRFEGHDITIQDVFEAVGAHARGKITDAQLLDIEDHACPGAGACGGQFTANTMATVMELIGLSPMGTAAVPQVDKRKDAVAYRCGEVILNAVRKNILPRDICTRKAFENAIAGVAGTAGSTNAVLHLLAMAREAEVPLTIDEFEPVLARTPVFVDIKPGGKYMAADVDKAGGIPVIANRLLEGGYVDGSAITITGRTFAEEANEAKEVAGQPVILPLAKALKPRGGIAILRGSLAPEGCVIKLAGHEKKSHHGPARVFEREEEAMAAVQEGKIRENDVVVIRYEGPRGGPGMREMLGVTGAIVGAGLSDSVALLTDGRFSGATHGFMIAHVAPEAFNGGPIAVVQEGDMITVDATRGVLELDIPAGELKSRLAAWKPREPRYKKGVIAKYCKLVSSASEGAITQA

SEQ ID NO: 133 - DNA, 1680 bp, Roseiflexus sp.
atgtctagcgacctcaaacgccgcagtcgcaccattaccgatgggcgcacccgcgccggggcgcgcgccatgctcaaggcaatcggcttcaccgacgaagacctggcaaaaccgatcatcggcatcgccaatacctggatcgagacgatgccatgcaacatcaacctgcgcgcgctggcggcgcgggtcaaggaaggcgtgcgcgccgccggcggcacgccgatggagttcaacaccgtcgctatcgccgatggcgtcaccatgggtacggaagggatgaaggcgtcgctgatcagccgcgacctgattgccgactcgatcgaactgatggggcgcgggtatatgttcgacgcgatcatcgcgctggtggcatgcgacaaaacgatccccggagcagcgatgggattgacgcgcctgaacatccccggcttcctgctctacggcggatcgattgctcccggtcactggcgcggcaaagagatcaccatccagcatgtgtacgaagcgatcggtgcagttgccgccggtaagatgaccgacgaagaactgaaagagatcgaagatgccgcgtgccccggtccgggagcatgcggaggtcagtacactgccaacacgatggcaaccgtgatggaaattatcggtctctcgccgatggggacggctgcggtgccggctgccgacccgcgcaaagattcggttggataccgcgccgggcagttgattatggatgtgctgcgacgcgatctgaagccgcgcgatattctgacacgggcggcattcgagaatgcgatcgccagcgtggcgttgaccggcggctcgaccaacgcggtactccatctgctggcgctggcgcgtgaggcgggcgtgccgctaacgctcgacgatttcgacgcgatcagtcgtcgtacaccgctctgctgcgacctgatgccgagcgggaagtactctgccattcacgtcgatcaggcgggcggcattcaggtgattgcgagacgcctggtcgacggcggtttcgcgcacggcgatgcgatcaccgtcactggtcgcaccctggcggaagaggcggcggatgctgtcgaaacgccaggtcaggatgtgatccgtcccctcgataatccgatcaagccgacaggcgggttgctggtgctgcgcggcaatctggcgcccgaaggatcggtggtcaaactgttcggttatgagcgcacctaccaccgcggtccggcgcgcgtcttcgatggcgaagaggcggcaatggccgctatcgtcggcggtgaaattcgaccggacgatattgtgattattcgctatgaaggtccgcgcggcggtcctggcatgcgcgagatgctcggcgttacttccgcgattgtcggcgccggacttgggcagtcggtctcgctcattactgatggacgcttcagcggcgcgacgcgcggtgtgatgatcggacacgtggcgccggaggcggcgcgaggcggaccgcttgcgattgtgcaggagggggatgagatcgagatcaatctcgacgagcgccgtgttgatctgctgctgtcagaagaagagattgccgaccggttgctcgcctggcagccgccagcgccgcgttatgagtggggcgtgatggcgcgctacggtgcgctggtgtcgtcagcgtccgaaggcgccgtgctggtgacaccatga

SEQ ID NO: 134 - protein, 559 aa, Roseiflexus sp.
MSSDLKRRSRTITDGRTRAGARAMLKAIGFTDEDLAKPIIGIANTWIETMPCNINLRALAARVKEGVRAAGGTPMEFNTVAIADGVTMGTEGMKASLISRDLIADSIELMGRGYMFDAIIALVACDKTIPGAAMGLTRLNIPGFLLYGGSIAPGHWRGKEITIQHVYEAIGAVAAGKMTDEELKEIEDAACPGPGACGGQYTANTMATVMEIIGLSPMGTAAVPAADPRKDSVGYRAGQLIMDVLRRDLKPRDILTRAAFENAIASVALTGGSTNAVLHLLALAREAGVPLTLDDFDAISRRTPLCCDLMPSGKYSAIHVDQAGGIQVIARRLVDGGFAHGDAITVTGRTLAEEAADAVETPGQDVIRPLDNPIKPTGGLLVLRGNLAPEGSVVKLFGYERTYHRGPARVFDGEEAAMAAIVGGEIRPDDIVIIRYEGPRGGPGMREMLGVTSAIVGAGLGQSVSLITDGRFSGATRGVMIGHVAPEAARGGPLAIVQEGDEIEINLDERRVDLLLSEEEIADRLLAWQPPAPRYEWGVMARYGALVSSASEGAVLVTP

SEQ ID NO: 135 - DNA, 1701 bp, Rubrobacter xylanophilus
atgcagaccacggacctcaggcgcaagagccgcatcatgttcgaggggcgggaccgggcccccgcccgctcctaccttctgggcatgggctacactcgggaggacctcgagaagcccatcgtgggggtggcccactcctggatcgagaccatgccctgcaactacaaccaccgccggctggccgagaaggtcaaggagggcatccgggcggccgggggcacccccatggagctgaacaccatcgcgatctccgacgggatcacgatgggcacccaggggatgaagacctccctggtctcgcgcgaggtgatcgccgactccatcgagctggtggggcgcggccacatgttcgacgccatggtgatcctggtcggctgcgacaagaccatccccgccggggcgatggcgctggcccggctggacgtccccggcatggtcatctactccggctccatagccccggggcgcttcaggggccgcgacgtgaccatccaggacgtcttcgagggggtgggcgcccacgccgcgggcaagatgagcgacgaggagctgcgggagctggaggagggggcctgcccgggcgcgggggcctgcggcggccagtacaccgccaacaccatggccatagcgctgcagtttttgggcctctcgccggtgggctccgccgacccgcccgccctggacggccgcaaggaggcggtctgcgaggaggcgggccggctggtgatgcgcctgctggagcgggacctcaagccctcggacatcctgagccgcgcggccttcgagaacgccatcgcctccgtggccgctaccgggggctccaccaacgcggtgctccacttcctcgccctcgcccaggaggcgggcatcccgctggacatagaggacttcgaccgggtcagctcccgcacccccatcatcgcggacctgaagcccggcggccgctttacggccgtggacatggaccgcgcagggggctcccggctgctgggcgcgcggatgctggaggcgaacctcgtggacggctcccagcccaccgtcaccgggcgcaccctggccgaggagttcgagggcgcgcgggagcgcccggggcaggaggtgatcctctccgccgagaggtccctcagcgagagcggcggcctggtgatcctcaagggcaacctggcccccgagggctgcgtggtgaaggtcgcgggctacacccgccgccgccacgagggtccggcgcgcgtcttcgactccgaggagcaggcgatggaggcggtccaggccggccggatctcggcgggcgacgtggtggtgatccgctacgaggggccgcgcggcggccccgggatgcgcgagatgctgggggtgaccgccgcgctggtgggccaggggctcggcgagagcgtggcgctgctaaccgacgggcgcttctcaggggccacccgcgggctcatggtgggccacgtcgccccggaggcggcccgcggcggccccatagccgccctgcgcgacggggaccgcatcacgatcgacgtcaccggcaggacgctgagcgtggcgctcaccggcgaggagctgcggaggcgcctggagaactggcgggagcccgagccgcgcttcaggctcggggtgatggccaagtacgccgccctcgtctcctcggcctccgagggggcggtgaccgtcccggactggcagcgccgcgccacctga

SEQ ID NO: 136 - protein, 566 aa, Rubrobacter xylanophilus
MQTTDLRRKSRIMFEGRDRAPARSYLLGMGYTREDLEKPIVGVAHSWIETMPCNYNHRRLAEKVKEGIRAAGGTPMELNTIAISDGITMGTQGMKTSLVSREVIADSIELVGRGHMFDAMVILVGCDKTIPAGAMALARLDVPGMVIYSGSIAPGRFRGRDVTIQDVFEGVGAHAAGKMSDEELRELEEGACPGAGACGGQYTANTMAIALQFLGLSPVGSADPPALDGRKEAVCEEAGRLVMRLLERDLKPSDILSRAAFENAIASVAATGGSTNAVLHFLALAQEAGIPLDIEDFDRVSSRTPIIADLKPGGRFTAVDMDRAGGSRLLGARMLEANLVDGSQPTVTGRTLAEEFEGARERPGQEVILSAERSLSESGGLVILKGNLAPEGCVVKVAGYTRRRHEGPARVFDSEEQAMEAVQAGRISAGDVVVIRYEGPRGGPGMREMLGVTAALVGQGLGESVALLTDGRFSGATRGLMVGHVAPEAARGGPIAALRDGDRITIDVTGRTLSVALTGEELRRRLENWREPEPRFRLGVMAKYAALVSSASEGAVTVPDWQRRAT

SEQ ID NO: 137 - DNA, 1779 bp, Salinispora tropica
gtgacgacccggcctaacccactcttcgtcggcatcgagcgcgccccagcgcgcgcctccatgcgcgccacaggtctgtcgaccgaggacctgaagaagccgatgatcggggtagcgcacagttggatcggcacgatgccgtgcaacctcaaccaccggcggctcgcccaggaggtgatggccggcgtgcgcgccgcaggtggcaccccgatcgagatcaacaccatcgcgatctcggacgtgatcaccatgggcacggagggaatgcggacctcactggtgagccgcgaggtgatcgccgactccatcgagttggtatgccgcggccacggtctcgacggcctggtgaccctggccggctgtgacaagaccatacccggtgcggcgctggcccacgtgcgactcgacatccccggagccgtcatctattccggcacgatgatgccgggcgagcacctcgggcgcgacatcaccctgcaggatgtgtttgaggccgtcggcagcgccaccgccaccggctgcaccgacgagctcgacaagctcgagcgcgcggcctgtcccggtatcggggcctgcgcgggccactacacggccaatacgatggccgtggtgctggagttcctcgggctttccccgttcggctcgatggatccgccggcagtcgacgcccgcaaggacacggtctgccgccaggccggcgagctggtcatgcgggcggtggcagaagggctgcggcccagccggttcctgacgccctcctcgttgcgcaacgccatcgccgccggggtcgccaccggcggctcgacgaacatggtgctccacctgttggcgatcgctcgggaggcgggcatcccgctggacattgacgagttcgaccggatcagctcggtgaccccgatcatcgctgacctgcgtccaaacgggacgtacaccgcggtggacctcgaccgggcgggcggcacccgggtgatcgcccgccacatggtcgacgcgggcctgattgctggcgacgaaagcaccgtcaccggccgcaccgtcgcacacgaggccgcggacgcggccgagacacccggccaacgggtcgtcaccacggtggaggcacccctatcgccttccggtgctctcctgatcttgcggggtaacctagcgcccgatggcagtgtggtgaaggcacccggcgcggtgaccctgcggatgaccggcaccgcattggtgttcaactgcgaggaggaagcgatggccgcggtccagactggccgcgtccggccaggccacgtcgtcgtcatccgctacgagggtccgcgcgggggtccagggatgagggaaatgctcggagtgacctcggcgctcatcggccgcggcctgggcacgtcggtcggtctggtgaccgacggccgtttctcgggcgcgaccaggggactgatggtggggcacgtcgctccggaggcggcggagggcggaccgatcgcggcggtgtgcgacggtgaccggatcaccatcgacctgcagcggcgcgaatgctctgtcgacctggatccgggcgaactggccgcgcggatgcgagactggtcggctccgccaccgcgctacacgatcggcgtcatggccaaatactggtcgacggtctcgtcggcggccgtgggcgccgtgacgaccccgcaccccacccagggcccggcgacagcgtcaggtaaggccgaggagtgccagcaggcgagtgcggtcgagggcgtgatggcggttggcggcggcgatgtcggtgctgccggcggttcgtag

SEQ ID NO: 138 - protein, 592 aa, Salinispora tropica
MTTRPNPLFVGIERAPARASMRATGLSTEDLKKPMIGVAHSWIGTMPCNLNHRRLAQEVMAGVRAAGGTPIEINTIAISDVITMGTEGMRTSLVSREVIADSIELVCRGHGLDGLVTLAGCDKTIPGAALAHVRLDIPGAVIYSGTMMPGEHLGRDITLQDVFEAVGSATATGCTDELDKLERAACPGIGACAGHYTANTMAVVLEFLGLSPFGSMDPPAVDARKDTVCRQAGELVMRAVAEGLRPSRFLTPSSLRNAIAAGVATGGSTNMVLHLLAIAREAGIPLDIDEFDRISSVTPIIADLRPNGTYTAVDLDRAGGTRVIARHMVDAGLIAGDESTVTGRTVAHEAADAAETPGQRVVTTVEAPLSPSGALLILRGNLAPDGSVVKAPGAVTLRMTGTALVFNCEEEAMAAVQTGRVRPGHVVVIRYEGPRGGPGMREMLGVTSALIGRGLGTSVGLVTDGRFSGATRGLMVGHVAPEAAEGGPIAAVCDGDRITIDLQRRECSVDLDPGELAARMRDWSAPPPRYTIGVMAKYWSTVSSAAVGAVTTPHPTQGPATASGKAEECQQASAVEGVMAVGGGDVGAAGGS

SEQ ID NO: 139 - DNA, 1722 bp, Acidobacteria bacterium
atgaccgaaaaatccccaaagccacacaagcgtagcgacgccattaccgaaggtcccaaccgcgccccagcccgcgccatgctgcgcgccgccgggttcaccccggaagaccttcgtaagcccatcatcggcatcgccaacacctggatcgaaatcggtccctgcaacctgcaccttcgtgagctcgccgagcacatcaagcagggcgttcgcgaagccggcggtacgccaatggagttcaacaccgtctccatttctgacggcatcaccatgggctcggaaggcatgaaggcgtcgctggtcagccgcgaggtcatcgccgactccatcgaactcgtcgcgcgcggcaatcttttcgacggcctgatcgccctatcgggatgcgataaaaccatccccgggaccatcatggcgctcgagcgcctcgacatcccgggtctcatgctctatggcggctccatcgcgcccggcaaattccatgctcagaaggtcacgattcaagacgtcttcgaggcagtcggtacgcatgcgcgcggcaaaatgagcgacgctgatctcgaagaactcgaacacaacgcctgtcccggcgccggcgcctgcggtggacaattcaccgctaacaccatgtccatgtgcggcgaattcctcggcatctcgccgatgggcgctaacagcgtcccggcgatgaccgtagagaagcagcaggtcgcacgacgctgcggacacctcgtcatggaactggtccgccgcgacatccgccccagccaaatcatcacgcgcaaggcgatcgaaaacgcaatcgccagcgtcgccgcctccggcgggtcgaccaacgccgttcttcacttgctcgccatcgcgcacgaaatggacgtcgaactgaacatcgaagacttcgacaagatcagttcgcgcacgccactgctctgcgaactcaagcccgctggccgcttcaccgccaccgatcttcatgatgccggcggtattccgctcgtcgcgcaacgcctgctcgaagcgaacctgctgcacgccgacgcactgactgtcaccggtaagaccatcgccgaagaagcgaagcaggcgaaagaaacgccgggccaggaagtggttcgtccgcttaccgatcccatcaaagctaccggcggcctcatgatcctgaaaggcaacctcgcatccgaaggctgcgtggtcaaactcgtcggacacaagaagctcttctttgaaggccccgctcgcgtcttcgagtcggaagaagaagcctttgcgggcgtggaagaccgcaccatccaggcgggcgaagtggtcgtggtccgatatgaaggcccgaagggcggccctggcatgcgcgaaatgcttggcgtgacggcggccatcgccggcaccgaactcgccgagaccgtcgcgctcatcaccgacggacgtttctccggcgctacccgcggcttgagcgtgggccacgttgcgcccgaagccgcgaatggcggcgcgatcgctgtggtacgcaatggcgacatcatcactctcgacgtggaacgccgcgaactgcgcgtccacctcaccgacgcagaactcgaagcgcgcctccgcaactggcgcgcgccggagccacgatacaagcgcggcgtcttcgccaagtatgcgagcaccgtttcgtcggcgtcgttcggggccgttaccggctccaccatcgaaaacaagaccttagccgggagtacgaagtag

SEQ ID NO: 140 - protein, 573 aa, Acidobacteria bacterium
MTEKSPKPHKRSDAITEGPNRAPARAMLRAAGFTPEDLRKPIIGIANTWIEIGPCNLHLRELAEHIKQGVREAGGTPMEFNTVSISDGITMGSEGMKASLVSREVIADSIELVARGNLFDGLIALSGCDKTIPGTIMALERLDIPGLMLYGGSIAPGKFHAQKVTIQDVFEAVGTHARGKMSDADLEELEHNACPGAGACGGQFTANTMSMCGEFLGISPMGANSVPAMTVEKQQVARRCGHLVMELVRRDIRPSQIITRKAIENAIASVAASGGSTNAVLHLLAIAHEMDVELNIEDFDKISSRTPLLCELKPAGRFTATDLHDAGGIPLVAQRLLEANLLHADALTVTGKTIAEEAKQAKETPGQEVVRPLTDPIKATGGLMILKGNLASEGCVVKLVGHKKLFFEGPARVFESEEEAFAGVEDRTIQAGEVVVVRYEGPKGGPGMREMLGVTAAIAGTELAETVALITDGRFSGATRGLSVGHVAPEAANGGAIAVVRNGDIITLDVERRELRVHLTDAELEARLRNWRAPEPRYKRGVFAKYASTVSSASFGAVTGSTIENKTLAGSTK

SEQ ID NO: 141 - DNA, 1668 bp, Thermus thermophilus
atgaggtcggaccagatcaagaagggactcaagcaggcccccgcccgcgccatgctccgggcggtgggggtgggggacgaggacttcggaaggcccttcgtgggggtggtgaacaccttcaccgacgggatgccctgcaacttccacctgcgggagctggcccagcacctcaaggccgggctcagggaggcggggcttttcccctttgagttcggggcccccgccatctccgacgggatcagcatgggcaccccgggcatgcgggcgagcctcgtaagccgcgaggtcatcgccgacagcgtggagctcatcgcccagggctacctctacgacggcatggtggggctttccgcctgcgacaagaccatcccgggcacggccatgggggtgatccgcagcggcgtccccggcatggtcctctacggggggacgatcgcccccggggagtggcaaggccggaagctcaccatcgtggaggtctttgaggcggtggggcaaagggccgcggggaagatcagcgaggaggagcttttggagattgaacgccgggccatccccggccccggggcctgtggggggcagtacaccgccaacaccatggccatggccctcgaggccctgggcctctcccccgtgggctacaacgccatccccgccgtccaccccgaaaaggagcgggccaccaaggaggcggggaaaatcctcgcctgggccatcgcccacgactggaagcccaaggacttcctcacccggaaaagcttcctcaacgccgtcgccgccgtggccgccacgggggggagcaccaacgccgtcctccacctcctcgccctggccaaggaggcgggggtggagctcagcctggacgactttgaccagatctcccgcaagaccccggtgatcgcggacctccgcccttggggcacctacaccgcctgggagctgtatgaagccggggggacggccctcgtcttcaagcggcttctggaggcggggctcctctttggggaggagaagaccctcacgggccgcaccctggcggaggaggtggagcgggcctaccgggaacaagaggggcagaaggtggtcttccccgtggagaaggccctcaagccccacggggggctcgtggtgctcaaggggaacctcgcccctcaaggcgccgtcctcaagctcgcggggacggaacgcacctcctttgagggcccggcccgggtctttgactccgaggaggcggccatggagaaggtcctgaagggggagatccggcccggggacgtggtggtcatccgctacgtgggccccaagggggcgccggggatgcccgagatgctctcggtgacgagcgccatcgtgggggagggcctggggccggaggtggccctcctcaccgacggccgcttctccgggggcacccgcggcctcatgatcggccacatcgcccccgaggccttcgtgggcgggcccatcgccctcctggaagagggggaccgcatccggattgacgtggaaggccgccgcctcgaggtcctcctccccgaggaggagctggaaaggcggagggcccgctggcggccccgaccccccgccttcacccacggcctcttcgcccgctacgccgccctggtgcgccaggcggacgagggggcggtgctggaagacccgctctag

SEQ ID NO: 142 - protein, 555 aa, Thermus thermophilus
MRSDQIKKGLKQAPARAMLRAVGVGDEDFGRPFVGVVNTFTDGMPCNFHLRELAQHLKAGLREAGLFPFEFGAPAISDGISMGTPGMRASLVSREVIADSVELIAQGYLYDGMVGLSACDKTIPGTAMGVIRSGVPGMVLYGGTIAPGEWQGRKLTIVEVFEAVGQRAAGKISEEELLEIERRAIPGPGACGGQYTANTMAMALEALGLSPVGYNAIPAVHPEKERATKEAGKILAWAIAHDWKPKDFLTRKSFLNAVAAVAATGGSTNAVLHLLALAKEAGVELSLDDFDQISRKTPVIADLRPWGTYTAWELYEAGGTALVFKRLLEAGLLFGEEKTLTGRTLAEEVERAYREQEGQKVVFPVEKALKPHGGLVVLKGNLAPQGAVLKLAGTERTSFEGPARVFDSEEAAMEKVLKGEIRPGDVVVIRYVGPKGAPGMPEMLSVTSAIVGEGLGPEVALLTDGRFSGGTRGLMIGHIAPEAFVGGPIALLEEGDRIRIDVEGRRLEVLLPEEELERRRARWRPRPPAFTHGLFARYAALVRQADEGAVLEDPL

SEQ ID NO: 143 - DNA, 1725 bp, Maricaulis maris
atgacccacgacagacgcaaatcttcagacgccatcacagccggcgcggcccgcgccccggcccgggccatgttgcgcgcgaccggcatgacggatggtgatttcgacaagccgatgatcggggtgatcaacacctggaccacggtcacgccctgcaacatgcacctggcggacctggccgcgccagtccgcgaagccgttcgtgaagccggtggccatccggtcgacttcaacacgatcgtcgtgtccgacgggatctcgatgggtaccgaaggcatgcgtgcctcgctgatctcgcgcgaggtgatcaccgactcgattgaactggcgacccggggtcacagcctggatggcgtcgttatcctcgtcggttgtgacaagaccattccggcggccgcgatggcgctggcccgcatggatgtgcccggttgcatcctctacggcggcacgatcatgccgggcaagctgggcgatcaggccctgtccatccaggacgtgttcgaagctgtaggcgcccatgccgcggggaccctggatgatgcaggcctggacaaggtcgaaaaagcggcttgcccgggcgccggcgcctgtggcggccagtttaccgccaatacgatggccatgatcctgaccatgctgggtctgtctccgatgggcgtgaacgacattcccgccccgcaccccgacaagccggaggcggcggctcgctgcggccgactggctgtcgagctggcgaaatccggcaccaccccgcgccgtttcatcaccgaagcctcccttcgcaatgccgttgtcggcgcttccgcctcgggcgggtcgaccaatgccgtcctgcacgtcgccgcaatcgccgccgaagccggcataccgttcgacattgccgagttcgaccgtatctccagcgaagcccccgtcatcaccgacctgaagccgggcgggcgttttctggcccaccacatgttcctggccggcggctcccgcctgttcggtcagcgcctgatcgagggcggcttgctggctgataccccgactgtctccggcaagagcctgcatgaagagtgcgccagcgccgaagagtcactcaatcaacgtgtcatccaatccgttgccaacccggtcaaaccggatggtggtttccgcgtcctgaccggcgacctggcccccgaaggcgcagtcctgaaactgtcgggtcatgcccgcagcgaattttccggaccggcccgggtgttcgaatgcgaggaagacgccttcgccgccgtggaggccaactcggtcaaggctggtgacatcatcatcatccgcaatgagggccccaagggcggccccggaatgcgggaaatgctgggcgtgaccgccgccctggtcggtcagggactggccggcgatgtcgccctgatcaccgatggccgcttttccggcgcctccaagggcttcgtgatcggtcatgtcagccccgaggccgccgatggcggtccgatcggacgggtccgaaatggagacagggtgcgcattgatgtcgccgcccgccggatcgatgtcgatgccgacctgtctgcccgtccgcaatcctcgtccggccggcccgccccgaccggtgttttcgccaaatatgccgcgctggtctcttcggcctcgcgcggcgccaccaccatcatcgcgccgactgccaccaaggcgtcgccgcaaacaaccgacatgcaatccaagcaggagatgcccgcatga

SEQ ID NO: 144 - protein, 574 aa, Maricaulis maris
MTHDRRKSSDAITAGAARAPARAMLRATGMTDGDFDKPMIGVINTWTTVTPCNMHLADLAAPVREAVREAGGHPVDFNTIVVSDGISMGTEGMRASLISREVITDSIELATRGHSLDGVVILVGCDKTIPAAAMALARMDVPGCILYGGTIMPGKLGDQALSIQDVFEAVGAHAAGTLDDAGLDKVEKAACPGAGACGGQFTANTMAMILTMLGLSPMGVNDIPAPHPDKPEAAARCGRLAVELAKSGTTPRRFITEASLRNAVVGASASGGSTNAVLHVAAIAAEAGIPFDIAEFDRISSEAPVITDLKPGGRFLAHHMFLAGGSRLFGQRLIEGGLLADTPTVSGKSLHEECASAEESLNQRVIQSVANPVKPDGGFRVLTGDLAPEGAVLKLSGHARSEFSGPARVFECEEDAFAAVEANSVKAGDIIIIRNEGPKGGPGMREMLGVTAALVGQGLAGDVALITDGRFSGASKGFVIGHVSPEAADGGPIGRVRNGDRVRIDVAARRIDVDADLSARPQSSSGRPAPTGVFAKYAALVSSASRGATTIIAPTATKASPQTTDMQSKQEMPA

SEQ ID NO: 145 - DNA, 1662 bp, Parvularcula bermudensis
atgacccaaaacaaacgaagcgacgccatcaccaagggaccggcccgggccgctgcccgcgccatgctccgcgcgacgggcatgtcggacgccgatttcgacaagccgatggtggggatcatcaacacctacgcctcggtcactccctgcaatatgcatttgcgcgccctgggcgaagacgtccgcgccggtgtcgttgaggggggcggctggccggtcgagttcgggaccatcgtcgtctccgacggcattacgatgggccacgaagggatgcgggccagcctgatgtcgagggaggtgatcgccgactccatcgaactagccgtgcgcggccacgcgctcgatgcggccatcgtgctggtgggatgcgacaagaccattccggccgcagcgatggccctggcacgactcgatatccccgggatcgttttctacggcggcacgatcgcccccggctgtcacaaaggccaggatatcagcattcaggatgccttcgaagctgtcggcgcctatggccttggccggatcgatggcgacgaattgtcggcggtggaacgcgcggcttgccctggtgccggggcgtgcggtggccagttcacggcgaacactatggcgatggccatggcgtttctcggccttgcccccatgggcgccggcgaccccccggccctccatccggacaaaacgatcgaggctcggcgctgtggccaattggtggccgagaatgcccttggcaccaccgcccgcacctatgtctcgcccgagagcctccacaatgccgtctgtgccgttgtcgcctccggcggctccaccaatgcggtgctgcacctcgccgctatcgccgcggaggcgaaggtccccttctcgatcgatctgttcgaccagctttcgaggaccacgccggtgatcgcgaacctcaaaccgggggggcgttacctggcgcaggatctgttcgccgtcgggggcaatcgccggttcggcaaaatgctgatggaagcgggcgcgctgaaagatattcccacgacgagcggacgctctctctttgccgagttggccgaggcgccgccgagcgatgacaccgacgtgctgcgccctgtggacgcgccgctcaagcccaccggcgggctgcgcatcctctatggcgacgtggcgcccgacggcgccgtgctgaaaaccgccggctatggcgacggcgcctttgaggggccggcgcggatcttcgaatgtgaggaggattgcttcgcggcggttcaggccggcaccattgccgagggcgatgtcgtcgtgatccgcaatgaaggccccaaaggcggcccggggatgcgagagatgctcggcgtcacagcggccctcgccggacagggccttgcaggaaaggtcgccttgttgaccgacggccgattttcaggcgccagtcatggcttcgttatcggtcacatctcccccgaggcggcggtgggcggccccatcggcctgttgcaggagggcgaccggatttcgatcgacgccgaagggcggcgtatcgatgccgccatcgactggcaggcccgcaaagagaattataccccaaccccaaaggcgccccagggcggctatttcgacaaatatcgcgcgttggtcggctcggcgagccgcggcgccacaactctccaggaaggataa

SEQ ID NO: 146 - protein, 553 aa, Parvularcula bermudensis
MTQNKRSDAITKGPARAAARAMLRATGMSDADFDKPMVGIINTYASVTPCNMHLRALGEDVRAGVVEGGGWPVEFGTIVVSDGITMGHEGMRASLMSREVIADSIELAVRGHALDAAIVLVGCDKTIPAAAMALARLDIPGIVFYGGTIAPGCHKGQDISIQDAFEAVGAYGLGRIDGDELSAVERAACPGAGACGGQFTANTMAMAMAFLGLAPMGAGDPPALHPDKTIEARRCGQLVAENALGTTARTYVSPESLHNAVCAVVASGGSTNAVLHLAAIAAEAKVPFSIDLFDQLSRTTPVIANLKPGGRYLAQDLFAVGGNRRFGKMLMEAGALKDIPTTSGRSLFAELAEAPPSDDTDVLRPVDAPLKPTGGLRILYGDVAPDGAVLKTAGYGDGAFEGPARIFECEEDCFAAVQAGTIAEGDVVVIRNEGPKGGPGMREMLGVTAALAGQGLAGKVALLTDGRFSGASHGFVIGHISPEAAVGGPIGLLQEGDRISIDAEGRRIDAAIDWQARKENYTPTPKAPQGGYFDKYRALVGSASRGATTLQEG

SEQ ID NO: 147 - DNA, 1683 bp, Oceanicaulis alexandrii
atgaccgataacaaacgcccctcgcacacactgatccaggggccggcccgcgccccggctcgcgccatgcttcgcgcggccggctatgacgatgaccggatggcgaaacccatgatcgccatcgtcaacacctggaccagcgtcaccccgtgcaacatgcaccttcagggtctcgccgatcatgcccgcgccgggatcgaggcggcaggcggcacggcggtggatttcaacaccatcgtcgtcaccgacggcatctccatgggcaccgaaggcatgcgcgccagcctgatgagccgcgattgcgtggcggactccgccgaactcgccgtgcgcggccattgcctggacgccgtgctgttcctggtgggctgcgacaagaccctgcctggcgccgccatggcggcggcgcggctgaacctgcccagcgtcgtgctctatggcggctcgatcatgccgggcaagctgggcgacaaggcggtgacgattcaggacgtgttcgaggccgtcggggcctgcgcggcgggcaagatcagcgaagacgaactcgtcgaagtcgaaaaagccgcctgccccggcgcgggcgcctgcggcggccagttcaccgccaacaccatggcgctggcgctgaccgcgctcggcctgtcgcccatggggctcaacgacattcccgccgttcatcccgacaagcccgaagccgcgcgcaaggccggtcaggccgtggtcgatgcgctgaaggcggatcgcaagccgcgcgacatcatcaccccgacctctctgaaaaacgccgccgtcgcggtgaccgccacggcgggctccacaaacgcggtcctgcatcttctggccattgcccgcgaagccggggtcagccgggatcagttcgacattgatgtgtttgacgccgtgagccggaagactccggtgatcgccgatctcaagcccggcggtcgctatatggcgccggacatggcggctgcgggcggggcacgcctgctgctgcagcgcctgaaagccgcggacatgctggacgatgcgcccaccgtcaccggcaagaccctgtttgaagaagccgagctggccgctgaaacgccgggtcaggacgtgatcctgtcgcccgacaaaccgctcaagaagcgcggcggcttcggcgtgctttatggcgatctcgccccggaaggctgcgtcgccaagctcgcgggtcatgaccgtctgttctttgaaggccccgccaaggtatttgattgcgaggaagactgcttcgccgcggtcaattcgggcgggatcgagaagggcaatgtggtcgtcatccgcaatgaaggccccgccggcgggccgggcatgcgtgaaatgctggccgtcaccgccgccattcaaggcgcaggcctgggcgatgatgtggcgttgatgacggacggccgcttctcgggcgcgacctatggcttcatggtcgggcacgtcgcccccgaagccgcccatggcggacccatcgcctttgtgaagaccggcgatatcatcaccatcgatatcgagaaccgtcgcattgatgtgaaggccgatctcaaggcgcgcatggcccagggcttcaccccgcccgaacccaaataccgcacgggggcgttcgcgaaatacgccaggctcgtccactccgcatcagatggcgcggtgacgagcttcccgttcgactag

SEQ ID NO: 148 - protein, 560 aa, Oceanicaulis alexandrii
MTDNKRPSHTLIQGPARAPARAMLRAAGYDDDRMAKPMIAIVNTWTSVTPCNMHLQGLADHARAGIEAAGGTAVDFNTIVVTDGISMGTEGMRASLMSRDCVADSAELAVRGHCLDAVLFLVGCDKTLPGAAMAAARLNLPSVVLYGGSIMPGKLGDKAVTIQDVFEAVGACAAGKISEDELVEVEKAACPGAGACGGQFTANTMALALTALGLSPMGLNDIPAVHPDKPEAARKAGQAVVDALKADRKPRDIITPTSLKNAAVAVTATAGSTNAVLHLLAIAREAGVSRDQFDIDVFDAVSRKTPVIADLKPGGRYMAPDMAAAGGARLLLQRLKAADMLDDAPTVTGKTLFEEAELAAETPGQDVILSPDKPLKKRGGFGVLYGDLAPEGCVAKLAGHDRLFFEGPAKVFDCEEDCFAAVNSGGIEKGNVVVIRNEGPAGGPGMREMLAVTAAIQGAGLGDDVALMTDGRFSGATYGFMVGHVAPEAAHGGPIAFVKTGDIITIDIENRRIDVKADLKARMAQGFTPPEPKYRTGAFAKYARLVHSASDGAVTSFPFD

SEQ ID NO: 149 - DNA, 1605 bp, Plesiocystis pacifica
atgctgcgcgccacgggcctcgaagacgaggacctcgccaagccgctgatcgccgtggtcaacacctggagcgacgtgaccccctgcaacgtgcacctgcgcgggctcggggaggcggtccgccgcggggtccaagacgctggcggaacgcccttcgagttcaacaccatcgtcgtcagcgacggcatctccatgggcacggagggcatgcgggcgtcgctggtctcgcgggaggtcatcgccgacagcatcgagctcgccgtgcgcgggcacagcctggacgcggtcgtggtcatcgtgggctgcgacaagacgatcccggcggcggccatggccctcgcgcgcctcgatcgtccggggctggtcctctatggcggctcgatcgccaagggccggcaccggggggccgacgtcagcattcaggaggtcttcgaggccgtgggcgcctgcgcggccgggcgcatcgacgcggacgagctcgacgccatcgagcgcagcgcgtgcccgggcgcgggggcctgcgggggccagttcacggccaacaccatggcccaggtgctgaccttgctcgggctctcgcccctgggcgcgaacgacattccggccacgcacccggccaagctcgaggtcgccgaggcttgcgggcgtcaggtcctcgagctgctcgagcgcgagctccggccgagcagcttgctgaaccgggcggccttcgcccgggcgacggcgggggtggccgcgagcaagggctcgaccaacgccgtgctccacatcctcgccatcgcccgggaggccggctgcgacttctcgttgcgcgagctcgacgaggtctgcgcggcgacccccgtgctctgcgacctcaagccctcggggcgctacctggccgtcgacatgagcgaggccggcgggacggccctgctcgcccggcggctgttcgaggccgggctgtgcgaggacggggcgagcgtcgacgggccctcgctccgggccctggtcgccgacgcccccgagcgcgaggggcagcgggtgatccggccggcgagccaggccttcgcgccccggggcgggctcatggcgctgttcggcaacctggcgcccgagggctgcgtgctcaagctgccccccgagctccccgaggtgttcgagggggtcgccagggtgttcgacgacgaggactcggccttcgccgcggtgcaggccggcgccgtcgaggccggcgacgtcgtcgcgatccgctacgaggggccggccggcggcccgggcatgcgcgagatgttggcggtcacggctgccctcgtgggtcggggcctcggcgggcgcgtggcgttgatcaccgacgggcgcttttcgggggcgagccacgggctggtcatcggccacgtcgcccccgaggccgcccggggcggccccctggccaggctccgcgacggcgaccgcgtgcgcatcgacgtcgtcggccagcgcctcgacgtgctcgacgcggacttcgaggcccggcgaagcccggccgcgaaggcgcctcgctacctcaccggcgccctcgccaagttcgccgcgctggtcgactcggccagcgaaggcgccacgacttctcgtccgcagttttga

SEQ ID NO: 150 - protein, 534 aa, Plesiocystis pacifica
MLRATGLEDEDLAKPLIAVVNTWSDVTPCNVHLRGLGEAVRRGVQDAGGTPFEFNTIVVSDGISMGTEGMRASLVSREVIADSIELAVRGHSLDAVVVIVGCDKTIPAAAMALARLDRPGLVLYGGSIAKGRHRGADVSIQEVFEAVGACAAGRIDADELDAIERSACPGAGACGGQFTANTMAQVLTLLGLSPLGANDIPATHPAKLEVAEACGRQVLELLERELRPSSLLNRAAFARATAGVAASKGSTNAVLHILAIAREAGCDFSLRELDEVCAATPVLCDLKPSGRYLAVDMSEAGGTALLARRLFEAGLCEDGASVDGPSLRALVADAPEREGQRVIRPASQAFAPRGGLMALFGNLAPEGCVLKLPPELPEVFEGVARVFDDEDSAFAAVQAGAVEAGDVVAIRYEGPAGGPGMREMLAVTAALVGRGLGGRVALITDGRFSGASHGLVIGHVAPEAARGGPLARLRDGDRVRIDVVGQRLDVLDADFEARRSPAAKAPRYLTGALAKFAALVDSASEGATTSRPQF

SEQ ID NO: 151 - DNA, 1713 bp, Bacillus sp.
ttgggaagagatcttagaataaaaagccatgtaatcagcgaggatgaaaggcgcgcaccaaaccgggcgatgctgcgggcagtagggttcacggatgaagatttcaaaaagccgatgatcggcattgcaagcacatggagcgaagtgactccgtgcaatatacatatcaatgaacttgcattcaaggcgaaggacggtgccagggaagccgggggagctccgcttgtattcaatacgattactgtttctgacggaatctccatgggaacagaggggatgaggtattcccttccgagccgcgacctgattgctgattccattgaaacggtcgttgggggtgaaagcctggacggctttgttgccattggaggctgcgataaaaatatgcccggctgcctgatggccatcgcaaggatgaacctgcctgctgtttttgtgtatgggggcacaatcaagcctggcaagctgcagggacaggatatcgatattgtgtcagtatttgaaggggtaggacagttcaatggtggggccattgataaagctggactcaatgagatcgaatgccatgcatgtccgggggccggctcctgcggcggaatgtacacagccaatacgatggcaagcgctatcgaggcgctgggaatgagccttccgggcagttcctccaatccggcagaaacagatgaaaagcggcaggattgccatgaagcaggaaaggcagtctaccgccttttggagcaggatatcaggccaagggatattcttacgaaggaagcgtttgagaatgcaattactgtcgtgatggctttgggcggttcgacaaatgccatcctccatttgatggccatcgcccattctgctgaagtggatctgtcacttgaggacttcaaccgccttcagaaaacggtcccccatatagccgatttaaagccgagcggaaaatatgtcatgcagaatctccatgaagcaggaggagtcagtgcagttatgaaaatgctgctgagggaagggctgcttcacggcgattgtctgactgtgacgggcaagacgctcgctgaaaatctggaagaagcagaagatctgaaagctggccaaaaggtcatttacccgcttaatgcccctcttcgggaaaacgggccgcttgtagtcctgaaaggcaatcttgccccggaaggcgccgtagcgaaggtatccggcctgaaggtcaccaggcacaccgggcctgccaaggtgtttgatgatgaggagtctgctacagatgctgtcctgaagggtgacattcaggctggtgatgtactggttatcaggtacgaagggccaaaaggcgggcctggcatgccggaaatgctttctatttcgggcatcctcgtaggaaaaggtcttggcgaaagtgtggccctgctgacagacgggcgtttctcgggaggtacccatggccttgtggtaggacatatcgctccggaagcacaggtcggcggaccgattgccctaatacagacaggtgacaggattactattgacagcaccgaacagacacttgaagtggatgtctctcctgctgaactggaagagaggaagaaatcctgggatccgccgccgcttttaacccgcggagccctggctaagtatacaaggctcgtttcctccgcttcaaggggggctgtcactgaccattttgaggaagagcctgctgccaggccgcttaaagtgtag

SEQ ID NO: 152 - protein, 570 aa, Bacillus sp.
MGRDLRIKSHVISEDERRAPNRAMLRAVGFTDEDFKKPMIGIASTWSEVTPCNIHINELAFKAKDGAREAGGAPLVFNTITVSDGISMGTEGMRYSLPSRDLIADSIETVVGGESLDGFVAIGGCDKNMPGCLMAIARMNLPAVFVYGGTIKPGKLQGQDIDIVSVFEGVGQFNGGAIDKAGLNEIECHACPGAGSCGGMYTANTMASAIEALGMSLPGSSSNPAETDEKRQDCHEAGKAVYRLLEQDIRPRDILTKEAFENAITVVMALGGSTNAILHLMAIAHSAEVDLSLEDFNRLQKTVPHIADLKPSGKYVMQNLHEAGGVSAVMKMLLREGLLHGDCLTVTGKTLAENLEEAEDLKAGQKVIYPLNAPLRENGPLVVLKGNLAPEGAVAKVSGLKVTRHTGPAKVFDDEESATDAVLKGDIQAGDVLVIRYEGPKGGPGMPEMLSISGILVGKGLGESVALLTDGRFSGGTHGLVVGHIAPEAQVGGPIALIQTGDRITIDSTEQTLEVDVSPAELEERKKSWDPPPLLTRGALAKYTRLVSSASRGAVTDHFEEEPAARPLKV

SEQ ID NO: 153 - DNA, 1686 bp, Oceanobacillus iheyensis
atgggaaaagatttgcggataaaaagtaaagcatttgacggtactatgcgagctccaaatagggcaatgcttcgtgcggtcggtctgacagatgaagattttaagaagcctatgattggtgtagcaagtacatgggcagaagtaacaccatgtaatatacatttaaatgatttagctcttcttgccaaaaaaggggtccggcactcggatgctgttcctttggtctttaatacgataaccgtatctgatggaatttccatgggaacacaaggtatgaactactcattgccgagtcgagatcttattgctgattcaatcgaaaccgttgttggagcagaaaatttagatggattagtagcaattggagcctgtgacaagaatattccagggtgcttgattgcgattgctaatgcaggagttccctcggtatttgtatatggcggaacaattgccccaggaaatgtggatgggaaagatatagatattgtttcagttttcgaaggagtaggacaacataatgcaggagctattgacgataatcaattaagaaaagtagaatgtaatgcttgtccaggtgcaggagcatgtggtggaatgtataccgccaatacaatggcctctgcagcggaagctttaggaatcagtttaccgggaagctcttctaacccagctgaatcagaagaaaagcagggtgatgtggaggcagctggtgaagcgattaaagatttattagagaaaggtatttatccaaaagatattctaacgaaaaaagcttttgaaaatgcaattacagtagttatggcattgggaggatctacaaatgcgatcttgcatttactagcagtttctcatgccgcagaagtagacttaacgattgatgattttaatcgaatccagaaaaaagtaccgcatttagccgatttaaaaccaagtggacgttttgtaatgcaagaccttcatcgagttggtggggtacaagcagtaatgaaattattgcatgaaaatggatacttacatggcgactgtcttactgtaacaggaaagactatagcagaaaatctagctgaagctcctgctttgaaagaaaatcaacaagtcattatgccgtttgataatccaaaaagggaagatggtcctctgattgtcttaaaggggaatttatcaccaactggtgctgtggcaaaagtatcaggggtgaaagtgaaacgacacacaggtcctgcacgtgtattcaacacagaaaaagaggcaactcaagcaattctggataacaaaattaaagagggagatgtattagttattcgttatgttggaccaaaaggtggtcccggaatgccggagatgttgtctgtttctagtattcttgtaggtaaaggaatgggagaatcggtagctttattgacggatggtagattctctggtggtacacatggtcttgtggtaggtcatataagtccagaggcacaagatggcggaccaattgcatttctgcaagaaggagatatggtgaccatagattctaataaaagagaaatttccatggacgtttcggaagatgaaataaaactacgtcaaggaaaatgggaagcccctgaactacataagaaaggggttcttggaaaatatgcacataatgttacttgctcatccaaaggtgcagtaacagattatttgaaccgagaataa

SEQ ID NO: 154 - protein, 561 aa, Oceanobacillus iheyensis
MGKDLRIKSKAFDGTMRAPNRAMLRAVGLTDEDFKKPMIGVASTWAEVTPCNIHLNDLALLAKKGVRHSDAVPLVFNTITVSDGISMGTQGMNYSLPSRDLIADSIETVVGAENLDGLVAIGACDKNIPGCLIAIANAGVPSVFVYGGTIAPGNVDGKDIDIVSVFEGVGQHNAGAIDDNQLRKVECNACPGAGACGGMYTANTMASAAEALGISLPGSSSNPAESEEKQGDVEAAGEAIKDLLEKGIYPKDILTKKAFENAITVVMALGGSTNAILHLLAVSHAAEVDLTIDDFNRIQKKVPHLADLKPSGRFVMQDLHRVGGVQAVMKLLHENGYLHGDCLTVTGKTIAENLAEAPALKENQQVIMPFDNPKREDGPLIVLKGNLSPTGAVAKVSGVKVKRHTGPARVFNTEKEATQAILDNKIKEGDVLVIRYVGPKGGPGMPEMLSVSSILVGKGMGESVALLTDGRFSGGTHGLVVGHISPEAQDGGPIAFLQEGDMVTIDSNKREISMDVSEDEIKLRQGKWEAPELHKKGVLGKYAHNVTCSSKGAVTDYLNRE

SEQ ID NO: 155 - DNA, 1695 bp, Staphylococcus saprophyticus
ttgactaaagaacacagcgaacaacaaaaagatttacgtattcgcagcaaagtaattagtgaaggtgtcagtcgtacacccaatcgagcttatttacgggcactcggctttgaagatgaagattttcaaaaaccaatgattggtgttgcaagtacttggagtgaagtcacgccatgtaatatgcatattgatggtttagctcgtgcttcaaaacaaggcattagtgaggcaggtgcttcgccacttattttcaataccattacagtatcagatggtatttcaatgggaacagacggtatgcgcttctctttaccaagtcgtgaaattatcgcggattctatagaatcagttgtcagtgctgaaaatttagatgcacttgtcgctattggtggttgtgacaaaaacatgccgggatgtatgattggtatcgctcgtcttaatttaccagctgtctttgtttatggcggcacaatattgcctgggaaattggatggtaaagatttagatgctgtttctgcctttgaaggcgtcggacagtataataatggcgaaatagataaagaggcacttcacaaagtagaatgtgccgcttgtccaggggccggtgcttgtggtggtatgttcactgccaatacgatgtcatctgctattgaggccatgggcatgagtttaccaggaagtgcttcgcatccagcagtttctacaaataaatccaaagacagcagagcagcaggtaaagccgtttataaactattagaaaaaggcatctatccaaaagatattatgactaaagaagcatttgaaaatgcaattactgtagtcatggcacttggaggatctaccaatgcaattttacatttacttgctattgcacatacaatcgaagtcgatttaacacttgatgatttcgaaaaaattcgtaagcgtgtcccacatatcgctgacttgagaccaagtggtaaatatgtcatggcacatcttgatgaagtcggtggtattccagcagttatgaaattattacatgacaaaggcttaatccatggagattgcttgaccgtaactggcaagactgttgctgaaaaccttgaacaacaacctgacctaaccgataataaatctatcattgattttgacaatccaaaacatgctactggaccgcttgttatcttgaaaggaaatcttgccccagaaggcgccgttgcaaaaatctcaggtctgagcgtaacttatatcaaaggacccgcacgcgtatttgattccgaatctaaggctaccaaagccatcttaaatgacgaaatcaaaccaggtgacgtggtcgttattcgatatgctggccctaaaggtgcacctggcatgcctgaaatgctatctgcatcatccattcttgtgggtaagggattaggtgaatctgtagcgttactcacagatggccgtttctctggcggttctcatggtcttgttatcggacacgcagcgccagaatcacaagttggcggtccgatggcattattagaagaaaacgacacgattaccattgacgcagaaaaacttgaaattagttttgatgtatcagacgaagaacttgagcgtcgtaacaaacaatggcaagcaccacctttaaaagccaatcgaggtacgctagctaagtatgctaagcttgtgtcatccgcttcaaaaggagctatcacagactaa

SEQ ID NO: 156 - protein, 564 aa, Staphylococcus saprophyticus
MTKEHSEQQKDLRIRSKVISEGVSRTPNRAYLRALGFEDEDFQKPMIGVASTWSEVTPCNMHIDGLARASKQGISEAGASPLIFNTITVSDGISMGTDGMRFSLPSREIIADSIESVVSAENLDALVAIGGCDKNMPGCMIGIARLNLPAVFVYGGTILPGKLDGKDLDAVSAFEGVGQYNNGEIDKEALHKVECAACPGAGACGGMFTANTMSSAIEAMGMSLPGSASHPAVSTNKSKDSRAAGKAVYKLLEKGIYPKDIMTKEAFENAITVVMALGGSTNAILHLLAIAHTIEVDLTLDDFEKIRKRVPHIADLRPSGKYVMAHLDEVGGIPAVMKLLHDKGLIHGDCLTVTGKTVAENLEQQPDLTDNKSIIDFDNPKHATGPLVILKGNLAPEGAVAKISGLSVTYIKGPARVFDSESKATKAILNDEIKPGDVVVIRYAGPKGAPGMPEMLSASSILVGKGLGESVALLTDGRFSGGSHGLVIGHAAPESQVGGPMALLEENDTITIDAEKLEISFDVSDEELERRNKQWQAPPLKANRGTLAKYAKLVSSASKGAITD

SEQ ID NO: 157 - DNA, 1752 bp, Bacillus selenitireducens
atgatagacgttatatggcatgtgagattatgtacattgacagaaagggtgaatgttgtgagtgagaaggatttgcgtcataaaagtaaagtgatcagtgaaggggtaaaccgggttccgaaccggtcaatgctgcgtgcagtcgggtttaccgatgaggatttcaagaaaccgatgattggggttgcgagtacgtggagtgaggtcaccccttgtaatgtacatattgatgccttggcaagagatgccaagctcggagcggcagaaggcggcggagcgccgatgatcttcaatacgatcatggtcgctgacgggattgcgatggggcatgaaggcatgagctattccctgccgtcaagggaagtcatcgccgattccattgaaacggttgtcggagcagaagccctcgacgccgtcgtcgccattggcggttgtgacaaaacaacgccgggctgtctcatttccatgggacggatgaatgtaccgggcgtctatgtgtatggcggtacgatcaaaccggggaaactcgatggcaaggacatcgacatcgtcaactccttcgaggcagtcggtcagtaccagagcggcaagcttgatgaggaaggccttcataaagtggaatgttctgcctgccctggaccgggttcctgcggcgggatgtacacggcaaatacaatggccgcagcggcagaagcgctcggcatgagtattccaggctcatcatcgacgcctgcagtggatgattataagcatcaggagtgcaggcaggccggcgatctgacggttcagcttttggaaaaagacatcaagccccgtgatattatgacgaagaaggcgtttgagaatgccattaccgtcgtcatggccctcggcggctcaacaaatgccttcctgcatcttcttgcgattgcgagaagcgttgacgtcgacttgacgtatgatgactttgaacgggtccgcaagaacgtcccgcatattgccgatctgaagccaagcggtcagtatgtcatggaagacctcttccaggcagggggcgtgcctggcgtgatgaagctgcttcttgaagccggcctcctacatggcgactgcatgacggtaactggcaagacgattgccgagaaccttgcagctgcggaaccgctgaaagaaggacaaaaagtgatttttccgcttgataagccgattaagccaagcggtccattgattgtcatgaaagggaatctggcccctgaaggcggggttgccaagatgagcggtcagtcgatcagtcattttgaaggtacgatcaaagtgtatgacagtgaggccgatgcgacgaaggccattgaagcgggagagatcgttgagggggatgtcctcgtcatccgctatgtgggtccaaaaggcggtccgggtatgccggagatgctctcgatcacggcgatgatcgtaggtcgaggcttgaacggtaaagtcgcactgatgacagatggccgattctccggcggttcacacggctttgttatcggtcatattgcaccggaagccgcagtaggcgggccgattgcgctgatcaagaatggtgacaaggtcacgatcgatgcggatacgcaggagatcaatctgcatattgatgaagcggagtttgagaagcggaaacaggaatggcagccgaagccgccgcggtttacgtacggcgtgttgaagaaatatgccaaactcgtttcgtcttcagcggaaggcgcaattacagacggtaaagaagccgattga

SEQ ID NO: 158 - protein, 583 aa, Bacillus selenitireducens
MIDVIWHVRLCTLTERVNVVSEKDLRHKSKVISEGVNRVPNRSMLRAVGFTDEDFKKPMIGVASTWSEVTPCNVHIDALARDAKLGAAEGGGAPMIFNTIMVADGIAMGHEGMSYSLPSREVIADSIETVVGAEALDAVVAIGGCDKTTPGCLISMGRMNVPGVYVYGGTIKPGKLDGKDIDIVNSFEAVGQYQSGKLDEEGLHKVECSACPGPGSCGGMYTANTMAAAAEALGMSIPGSSSTPAVDDYKHQECRQAGDLTVQLLEKDIKPRDIMTKKAFENAITVVMALGGSTNAFLHLLAIARSVDVDLTYDDFERVRKNVPHIADLKPSGQYVMEDLFQAGGVPGVMKLLLEAGLLHGDCMTVTGKTIAENLAAAEPLKEGQKVIFPLDKPIKPSGPLIVMKGNLAPEGGVAKMSGQSISHFEGTIKVYDSEADATKAIEAGEIVEGDVLVIRYVGPKGGPGMPEMLSITAMIVGRGLNGKVALMTDGRFSGGSHGFVIGHIAPEAAVGGPIALIKNGDKVTIDADTQEINLHIDEAEFEKRKQEWQPKPPRFTYGVLKKYAKLVSSSAEGAITDGKEAD

SEQ ID NO: 159 - DNA, 1704 bp, Streptococcus pneumoniae
atgactgaattagataaacgtcaccgcagtagcatttatgacagcatggttaaatcacctaaccgtgctatgcttcgtgcgactggtatgacagataaggactttgaaacaccgattgtgggagtgatttcgacttgggcggaaaatacaccatgtaacattcacttgcatgatttcgggaaactggctaaagaaggtgtcaaatctgcaggcgcttggcctgtacagtttggaaccattaccgtagcagacgggatcgctatgggaacgcctggtatgcgtttctctctaacatctcgtgacatcatcgcggactccatcgaggcggctatgagtggtcacaacgtggatgcctttgtcgctatcggtggctgtgacaagaacatgcctggatctatgattgctattgctaatatggatatcccagctattttcgcctatggtggaactattgcaccgggaaatcttgatggtaaagatatcgacttggtttctgtctttgaaggtatcggaaaatggaaccacggtgacatgacagctgaggacgtgaaacgtcttgaatgtaatgcctgccctggccctggtggctgtggtggtatgtatactgctaataccatggcaactgctatcgaagttctagggatgagtttgccagggtcatcctctcacccagctgaatcagctgataagaaagaagatatcgaagcagcaggacgtgctgttgttaagatgttggaacttggtctcaaaccatcagatatcttgactcgtgaagcctttgaagatgctattactgtaacgatggctctcggtggttctacaaacgccactcttcacttgctcgccattgcccatgccgcaaatgttgacttgtcacttgaggacttcaatacgattcaagaacgtgtgcctcacttggccgacttgaaaccatctggtcagtatgtcttccaagacctctacgaagtcggtggtgtccctgcggttatgaagtacttgttggcaaatggtttccttcacggagatcgcatcacatgtactggtaagactgtagctgaaaacttggctgactttgcagacttgactccaggccaaaaagttatcatgccacttgaaaatccaaaacgtgcggatggtccgcttatcatcttgaacgggaaccttgctcctgacggtgcagttgccaaggtatcaggtgttaaagtgcgtcgtcacgttgggccagctaaggtctttgactcagaagaagatgcgattcaggccgttctgacagatgaaatcgttgatggcgatgtagtcgttgttcgttttgttggacctaaaggtggtcctggtatgcctgagatgctgtcactttcttcaatgattgttggtaaaggtcagggagataaggtggccctcttgacggacggacgtttctctggtggtacttatggtctggttgttggacatatcgctcctgaagctcaggatggtggaccaattgcctatctccgtaccggcgatatcgttacggttgaccaagataccaaagaaatttccatggccgtatccgaagaagaacttgaaaaacgcaaggcagaaacaaccttgccaccactttacagccgtggtgtcctcggtaaatatgcccatatcgtatcatctgcttcacgcggagccgtgacagacttctggaatatggacaagtcaggtaaaaaataa

SEQ ID NO: 160 - protein, 567 aa, Streptococcus pneumoniae
MTELDKRHRSSIYDSMVKSPNRAMLRATGMTDKDFETPIVGVISTWAENTPCNIHLHDFGKLAKEGVKSAGAWPVQFGTITVADGIAMGTPGMRFSLTSRDIIADSIEAAMSGHNVDAFVAIGGCDKNMPGSMIAIANMDIPAIFAYGGTIAPGNLDGKDIDLVSVFEGIGKWNHGDMTAEDVKRLECNACPGPGGCGGMYTANTMATAIEVLGMSLPGSSSHPAESADKKEDIEAAGRAVVKMLELGLKPSDILTREAFEDAITVTMALGGSTNATLHLLAIAHAANVDLSLEDFNTIQERVPHLADLKPSGQYVFQDLYEVGGVPAVMKYLLANGFLHGDRITCTGKTVAENLADFADLTPGQKVIMPLENPKRADGPLIILNGNLAPDGAVAKVSGVKVRRHVGPAKVFDSEEDAIQAVLTDEIVDGDVVVVRFVGPKGGPGMPEMLSLSSMIVGKGQGDKVALLTDGRFSGGTYGLVVGHIAPEAQDGGPIAYLRTGDIVTVDQDTKEISMAVSEEELEKRKAETTLPPLYSRGVLGKYAHIVSSASRGAVTDFWNMDKSGKK

SEQ ID NO: 161 - DNA, 1719 bp, Streptococcus sanguinis
atgaaagggaaagctatgacagataaggatattcgtcacagaagtaagatttatgacagtatggttaaatctcctaaccgtgccatgcttcgcgcgacggggatgactgataaagattttgaaacgcctattgttggggtgatttccacttgggcggaaaatacaccctgtaacatccatttgcatgacttgggcaagctagccaaggaaggtatcaaagcagagggcgcttggcctgttcagtacgggactattacggttgcggacggaattgccatgggaacgccgggtatgcgcttctctctgacctcacgcgatatcatcgcagactccatcgaggctgccatgggcgggcataatgtggatgctttcgtagctatcgggggctgtgataaaaatatgccaggctccatgattgccattgccaatatggatattcctgctgtctttgcctacggcggaacgattgcgccagggaagctggacggtaaggacattgacttggtttctgtctttgaaggaatcgggaaatggaaccatggtgatttgacggctgaggaagtacgacgcattgagtgtaatgcctgccctggccctggtggctgtggtggtatgtatacggccaatactatggcgacggctattgaagttctgggtatgagcctgccaggctcctcttctcaccctgctgagtctaaagacaagcaagaggatatcgaagcagctggtcgtgctgttgtgaaaatgctgaaaatggggctgaagccgtctgacatcttgacacgtgaagcctttgaagatgcaatcacggtgaccatggctctgggtggttctactaatgctaccctgcacttgctggccatggcgcacgcggccaatgttgagctgacgcttgatgactttaatgtcattcaagagaaggtaccgcatttggctgacttgaaaccatctggtcagtatgtcttccaagacctttatgaggttggtggggtaccggctgtgatgaaatatctcttggcgaacggcttcctgcatggtgatcgcatcacttgtacaggtaagactgttgcagagaatctggtagaatttgctgatctgacaccaggtcaaaaggtcattatgccgcttgaaaatccaaaacgtgcggacggtccgctcattatcttgcatggtaatctggctccagatggtgctgttgccaaggtttctggtgttaaagtgcgccgtcacgttggaccggctaaggtctttgactcagaagaagcagctattgatgctgtactggccgatgaagtggtcgatggcgatgtggtcgtggttcgctatgttggaccaaagggtggccctggtatgccagaaatgctgtcactttcttctatcatcgtagggaaaggtcaaggggacaaggtggcacttctaactgacggccgcttctcaggcggtacttacggcttggttgtcggacacattgctccggaagctcaggatggtggcccgattgcctatcttcgtacaggcgatatggtcacggttgaccaagataccaaggaaatctctatggcagtctctgacgaagagctggcgaaacgtaaggcagaaacgactattccaccgctttatagtcgcggggtacttggtaaatatgctcacatggtatcgtctgccgctaaaggtgctgttactgacttctggaaaccagaagaaacaggtaagaaatag

SEQ ID NO: 162 - protein, 572 aa, Streptococcus sanguinis
MKGKAMTDKDIRHRSKIYDSMVKSPNRAMLRATGMTDKDFETPIVGVISTWAENTPCNIHLHDLGKLAKEGIKAEGAWPVQYGTITVADGIAMGTPGMRFSLTSRDIIADSIEAAMGGHNVDAFVAIGGCDKNMPGSMIAIANMDIPAVFAYGGTIAPGKLDGKDIDLVSVFEGIGKWNHGDLTAEEVRRIECNACPGPGGCGGMYTANTMATAIEVLGMSLPGSSSHPAESKDKQEDIEAAGRAVVKMLKMGLKPSDILTREAFEDAITVTMALGGSTNATLHLLAMAHAANVELTLDDFNVIQEKVPHLADLKPSGQYVFQDLYEVGGVPAVMKYLLANGFLHGDRITCTGKTVAENLVEFADLTPGQKVIMPLENPKRADGPLIILHGNLAPDGAVAKVSGVKVRRHVGPAKVFDSEEAAIDAVLADEVVDGDVVVVRYVGPKGGPGMPEMLSLSSIIVGKGQGDKVALLTDGRFSGGTYGLVVGHIAPEAQDGGPIAYLRTGDMVTVDQDTKEISMAVSDEELAKRKAETTIPPLYSRGVLGKYAHMVSSAAKGAVTDFWKPEETGKK

SEQ ID NO: 163 - DNA, 1719 bp, Streptococcus thermophilus
atggaggaaaacatcgtgtctgaaaataacatgaaacaccgttcttctgtctacgatagcatggttaaatcacctaaccgtgctatgcttcgtgcgactgggatgacggatgatagttttgaaaagcctattgttggggttatctcaacttgggctgagaacacgccatgtaatatccacttgcacggttttggtcaaattgccaaagagggtgtcaaagatgcgggtgcttggccagttcaatttggtacaattaccgttgcagatggtattgccatggggacaccagggatgcgtttctcattgacatctcgtgatattattgctgactcaatcgaagctgctatgggtggtcacaatgtcgatgcctttgttgctattggtggctgtgataagaacatgccaggttcaatgattgctattgccaacatggatattccagctatttttgcttacggtggtacgattgcaccgggtaatcttaacggtaaggatatcgacttggtttctgttttcgaaggtatcggtaaatggaaccacggagatatgactgccgaagaggttaaaaatcttgaatgtaatgcttgccctggccctggtggttgtggtggtatgtatactgctaacacaatggcaacagcaattgaggttatggggatgagccttccaggatcatcatctcaccctgcagaatcagctgagaagaaggctgatatcgaagaagcaggtcgtgcagttgtaaaaatgctagaaatgggacttaagccatcagatatcttgacacgtgaagcctttgaagatgccatcacagttacaatggcgcttggtggttcaacaaatgccactcttcacttgcttgctatcgctcatgcggctaacgttgatttaacgcttgaagacttcaacgatttccaagagcgcgtgcctcacttggctgacttgaagccttcaggtcaatatgtcttccaagacctttacaatgttggtggtgtgccagccgttatgaaatatcttcttaagaatggttttcttcacggtgatcgtatcacgtgtactggtaagactgttgcagaaaatttggaagctttcgatgatttgacaccaggtcaaaaagttatcatgccacttgaaaatcctaaacgtgccgatggtccattgattatcttgaaaggtaacttggccccagaaggtgctgttgccaaagtatcaggtgttaaagtgcgtaacattactggtcctgctaaagtatttgactcagaagaagatgccatcgaggcagttctttctgacgaaatcgttgacggcgatgtagttgttgtacgttttgtaggtcctaagggtggtcctggtatgccagaaatgttgtcattgtcatcaatgattgttggtaaaggacaaggagacaaggttgccctcttgactgatggacgtttctcaggtggtacttacggacttgttgtaggtcatattgctcctgaagctcaagttggtggaccgattgcctacctccgtacaggtgatatggttacagttgaccaggataccaaagaaatcactatgcatgtaccagacgaagagttggcgaaacgtaaagcagaaactgagttaccaccactttatagccgtggtgtcctcggtaagtatgctcacatcgtttcatcagcatcacgtggtgcggttactgacttctggaatatggataaatcaggtaaagcttaa

SEQ ID NO: 164 - protein, 572 aa, Streptococcus thermophilus
MEENIVSENNMKHRSSVYDSMVKSPNRAMLRATGMTDDSFEKPIVGVISTWAENTPCNIHLHGFGQIAKEGVKDAGAWPVQFGTITVADGIAMGTPGMRFSLTSRDIIADSIEAAMGGHNVDAFVAIGGCDKNMPGSMIAIANMDIPAIFAYGGTIAPGNLNGKDIDLVSVFEGIGKWNHGDMTAEEVKNLECNACPGPGGCGGMYTANTMATAIEVMGMSLPGSSSHPAESAEKKADIEEAGRAVVKMLEMGLKPSDILTREAFEDAITVTMALGGSTNATLHLLAIAHAANVDLTLEDFNDFQERVPHLADLKPSGQYVFQDLYNVGGVPAVMKYLLKNGFLHGDRITCTGKTVAENLEAFDDLTPGQKVIMPLENPKRADGPLIILKGNLAPEGAVAKVSGVKVRNITGPAKVFDSEEDAIEAVLSDEIVDGDVVVVRFVGPKGGPGMPEMLSLSSMIVGKGQGDKVALLTDGRFSGGTYGLVVGHIAPEAQVGGPIAYLRTGDMVTVDQDTKEITMHVPDEELAKRKAETELPPLYSRGVLGKYAHIVSSASRGAVTDFWNMDKSGKA

SEQ ID NO: 165 - DNA, 1716 bp, Streptococcus suis
atgaccgatacaaacaaacttaaagactttcgacatcgcagctctgtttacgattcgatggtcaaatcgcccaaccgtgctatgttaagagcaacaggaatgaccgacgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggtatgcgcttctccttgacttcacgtgatatcattgcagattctattgaggcagctatgggagggcacaacgtggatgcctttgtcgcaatcggtggctgtgataaaaacatgcctggttctatgattgctatcgccaatatggatatccctgctgtttttgcctacggcggaaccattgcgccaggtaatctcaatggtaaagacatcgacttggtatccgtttttgaaggaatcggaaaatggaacaacggtgacttgaccgctgaagaggttcgtcaaatcgagtgtaacgcttgccctggacctggtggttgcggtggtatgtacactgccaataccatggcgacagccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataa

SEQ ID NO: 166 - protein, 571 aa, Streptococcus suis
MTDTNKLKDFRHRSSVYDSMVKSPNRAMLRATGMTDDSFEKPIVGVISTWAENTPCNIHLHDFGKLAKEGVKEAGAWPVQYGTITVADGIAMGTPGMRFSLTSRDIIADSIEAAMGGHNVDAFVAIGGCDKNMPGSMIAIANMDIPAVFAYGGTIAPGNLNGKDIDLVSVFEGIGKWNNGDLTAEEVRQIECNACPGPGGCGGMYTANTMATAIEVMGMSIPGSSSHPAESPEKKADIEEAGRAVVRMLELGIKPSDIMTREAFEDAITVTMALGGSTNATLHLLAIAHAANVDLTLEDFNDFQERVPHLADLKPSGKYVFQDLYNVGGVPAVMKYLLKNGFLHGDRITCTGKTVAENLKNFADLTPGQDVIMPLENPKRADGPLIILKGNLAPEGAVAKVSGVKVRNHTGPAKVFDSEEEAIEAVLTDEIVDGDVVVVRYVGPKGGPGMPEMLSLSSMIVGKGQGDKVALLTDGRFSGGTYGLVVGHIAPEAQDGGPIAYLRTGDLVTVDQDTKEITMHVSDQEIEERKKTTVIPPLYSRGVLGKYAHTVSSASKGAVTDFWRPERTGKK

SEQ ID NO: 167 - DNA, 1716 bp, Streptococcus mutans
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatga

SEQ ID NO: 168 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 169 - DNA, 1683 bp, Leptospira borgpetersenii
atgagcgatatattaaaaaaaagaagttcgatgactacggacggagataaccgcgcgcccaatcgagcgatgcttcgcgcggtcggctttacggacgaagatttccacaaacctatgatcggaatcgcttccacatggagcgaagtgacgccttgtaatattcatatcaataagttggccgaaaaagtcaaagagggcgttcgtacggcgggaggagttcctcaaatttacggaaccatcacggtttccgacggaattacgatgggtcacgaagggatgcatttttcacttccctccagagaagtgattgcggattcaatcgaaatcgtttccaacgcgatgagacacgacggagtgatcgcgatcggaggttgtgataagaacatgcccggatgtctcatggctctttgcagaatcgatgctccttctattttcgtttacggggggaccattcttccggggcattgcgacggtcaagacgtggatatcgtttccatcttcgaagctgttggtaaatttaatgcaggtaaaatttcaagagaagaattcattcgaatcgagcagaacgcgtgtcccggcgcaggaagttgcggggggatgtataccgcaaatacgatgtcctccgcgatagaagctcttgggatgagtctgccaggttcggcttccatgcccgcggtgagttctagaaaatcggaggattgttacgaggcgggaaaagctctcatcaatctcattcaaaagggagtcactccgaagcgaattcttaccaaaaaagcttttgagaacgcgatcaccgtagtgcttgtgttaggcggttcaaccaatgcggtccttcatttgattgcgatcgcgaaagagattggtgtggatcttactctcgaagactttgatcgaatcagtaaaaaaactcctcaccttgcggatttgaaaccgggtggtagatacgccatgaccgatctcgacaaagtgggcggggttcatggtgtgatgaagtatcttttgaaagaaggaatgcttcatggtgattgtcttacggttacgggaaaaacaattgcagaaaatctaatggatatgcccgatctcgttccaaaccagacgatcgtccgtaaaaaatcggaggcgctccatccttccggtcctcttgtgattttgaaaggaaaccttgccccggaaggtgcggttgctaaaatttccggtttgaagaaaatttccatcacgggcccggcgaaagtgttcgaatccgaagacgattgtttcaatgcgatcatgacggatcaaattaaaccgggcgacgtgattatcattcgttacgaaggtcccaaaggtggtcccgggatgagagagatgctcgcggtaacttcggcgcttgtcggaaaaggtttgggagaagacgtgggtctgatgacagacggtcgattcagtggaggaacgcacggtctcgtagtcggtcatatttctcccgaagcatttgatggaggtccgattgcgatcgttcaaaatggggatgcggttactatcgattccggtaaaaatttgctccaagttgaaatttctcaggaagaaattcagaaacggctaaaaaattggaaaccgattgaaccgagatataaatccggggttcttgcgaaatacgcaaaactggttcaatcggcgactaacggagcgattacgaatctgctttga

SEQ ID NO: 170 - protein, 560 aa, Leptospira borgpetersenii
MSDILKKRSSMTTDGDNRAPNRAMLRAVGFTDEDFHKPMIGIASTWSEVTPCNIHINKLAEKVKEGVRTAGGVPQIYGTITVSDGITMGHEGMHFSLPSREVIADSIEIVSNAMRHDGVIAIGGCDKNMPGCLMALCRIDAPSIFVYGGTILPGHCDGQDVDIVSIFEAVGKFNAGKISREEFIRIEQNACPGAGSCGGMYTANTMSSAIEALGMSLPGSASMPAVSSRKSEDCYEAGKALINLIQKGVTPKRILTKKAFENAITVVLVLGGSTNAVLHLIAIAKEIGVDLTLEDFDRISKKTPHLADLKPGGRYAMTDLDKVGGVHGVMKYLLKEGMLHGDCLTVTGKTIAENLMDMPDLVPNQTIVRKKSEALHPSGPLVILKGNLAPEGAVAKISGLKKISITGPAKVFESEDDCFNAIMTDQIKPGDVIIIRYEGPKGGPGMREMLAVTSALVGKGLGEDVGLMTDGRFSGGTHGLVVGHISPEAFDGGPIAIVQNGDAVTIDSGKNLLQVEISQEEIQKRLKNWKPIEPRYKSGVLAKYAKLVQSATNGAITNLL

SEQ ID NO: 171 - DNA, 1665 bp, Candidatus Vesicomyosocius okutanii
atgtgcatcccaagaaaatattcctcacaagttgttgatggatttgaacgcgcaccaagtcgtgctatgctttaccccattggttttaaaaaagatgattttagcaaaccccaggttggtatagcaagcacttggtcaatggtaacaccatgtaatatgcatattaataaattagctgataaagccgaaaaagggataaataacgcaggtggtaaaggtgttatctttaacaccattaccatatcagatggtatttctatgggctctgaaggtatgaaatattccttagtatcacgcgaagtcattgccgattcaattgaaacagttgttggttgtcaagggtttgatggtgtggttgctattggtgggtgtgataaaaatatgcctggttgtattattggcttagcacgtcttaatcgccctagtatttttgtttatggcggtactattcaaccgggtaaaaatcgtacagatgtggtaagtgttttcgaagcagttggccgattttctaaccatgaaattgatgaaatagaactagaaaatattgaaaaaacagccgttactggagcaggttcttgtggtggtatgtacactgctaatactatggcatcagcaattgaagcattaggtatgagtttacccaactccagcgcacaaaatgctatatcagatgataaaaataatgattgtatccaagctggagaagctattcttactttattaaataaagacattaaaccccgtgatataatgactatgaaagcattcgaaaatgccatcactgtaattattgcattgggtggctcaaccaatgctgtattgcatttaattgccatggcaaatgccgctgaggttaatctcaaaattgatgattttactcgcattggtaaaaaagtacctgttattgctgaccttaaaccatcaggtaaatatatgatgagtgaattggttgaaattgggggtacattaccactaatgaaaatgctacttgatgcaggactattacatggggattgcatgacagtaacaggaaaaactttagctaaaaatttaaaaaatgttcaatcatatgctgattcccaagaaattattagagcattagataacccaataaagaaagattcacaccttagaattttgcgtggtaaccttgcaattaatggtgctgtggcaaagattactggtaaagaaggttcaagtttcaaaggtacagctaaatgtttttctcatgaagaaggagcgcttaaggctattttaaatgaccaaataaaagcaggtaatgttatcgttattcgttacgaggggcctgttggtggtcctggtatgcgtgaaatgcttgctcctacttctgcagttatggggaaaggattgggtggtaaaattgcacttattactgatgggcgcttctctggtggtacacatggttttgtagtcgggcatatcactcctgaagcctttaaaggtggagtgctagcagtggttgaagatggtgatgaaattataattgatgcacaaaataacgttttagaactattagttgatcaagctattattgataaacgcttatctaaatggacgcaacctaaaccaaactacactaaaggtgtattagcaaaatttgcaaaactagctaaatctgcttctgaaggtgcagttactgattaa

SEQ ID NO: 172 - protein, 554 aa, Candidatus Vesicomyosocius okutanii
MCIPRKYSSQVVDGFERAPSRAMLYPIGFKKDDFSKPQVGIASTWSMVTPCNMHINKLADKAEKGINNAGGKGVIFNTITISDGISMGSEGMKYSLVSREVIADSIETVVGCQGFDGVVAIGGCDKNMPGCIIGLARLNRPSIFVYGGTIQPGKNRTDVVSVFEAVGRFSNHEIDEIELENIEKTAVTGAGSCGGMYTANTMASAIEALGMSLPNSSAQNAISDDKNNDCIQAGEAILTLLNKDIKPRDIMTMKAFENAITVIIALGGSTNAVLHLIAMANAAEVNLKIDDFTRIGKKVPVIADLKPSGKYMMSELVEIGGTLPLMKMLLDAGLLHGDCMTVTGKTLAKNLKNVQSYADSQEIIRALDNPIKKDSHLRILRGNLAINGAVAKITGKEGSSFKGTAKCFSHEEGALKAILNDQIKAGNVIVIRYEGPVGGPGMREMLAPTSAVMGKGLGGKIALITDGRFSGGTHGFVVGHITPEAFKGGVLAVVEDGDEIIIDAQNNVLELLVDQAIIDKRLSKWTQPKPNYTKGVLAKFAKLAKSASEGAVTD

SEQ ID NO: 173 - DNA, 1680 bp, Candidatus Ruthia magnifica
atgcgaagaaaaattatgtacaacccaagaaaatactcctcacaagttgttgacggatttgaacgcgcgccaagtcgtgccatgctttatccagttggatttacaaaagaggattttaacaagcctcaagtcggcatagcaagcacttggtcaatggtaacaccgtgtaatatgcacattaataaattggctgatgagacattaaaaggggtaaatgccacaggtggtaaagccattatttttaacactattactatttcagatggtatttctatgggctctgaaggcatgaagtactctttagtctcacgtgaagttattgccgattcaattgaaactgtggttggttgtcaaggttttgatggtgtggttgcaattggtggttgcgataaaaacatgcctggttgtattattggtttggtacgtcttaatcgccctagtatttttgtttatggaggcacaatccagccgggtaaaaatcatacagatgtggtgagtgtttttgaagcagttggccaatttgccaatcatacaattgatgcgattgaattagaaaatattgaaaaaatagctatccctggtccaggctcttgtggcggtatgtatacggctaacactatggcatcagcgattgaagcattaggtatgagcctgccaaattctagtgcgcaagatgctatttcagatgataaaaataacgactgtgttcaagctggacaggccgtccttaatttattaaacaaagacattaaacctcgtgacattatgaccatgaaggcatttgaaaatgctattaccgtaattattgcattgggtggctcaactaatgctgtattgcatttaattgccatggcaagtgctgctgaggttaatcttaaaattgatgactttactcgcattggccaaaaagtacccgttattgctgaccttaaaccatcaggcaaatacatgatgagtgaattggttaaaattggcggtacattgccgctaatgaaaatgttacttgatgcaggattattgcacggagactgcctaacagtaacaggaaaaactctagctgaaaatttagaaaatgttaagccatacgctgattctcaagaaatcattagagcactagacaacccaataaaaaaagattcacaccttagaattttacgtggcaatcttgcaaccgatggtgctgttgcaaaaattactggcaaagaaggtttgagtttcaaaggcaatgcgaaatgtttttctcgtgaagaggatgcgcttgaagccattttaaataatcaaataataacaggtgatgtgattgttattcgctatgaaggccctgtcggaggtcctggtatgcgcgaaatgctcgcccctacttctgcagttatgggcaaaggcttaggtgataaagttgcgttaattaccgatggtcgtttttctggcggtacacatggttttgtagtcggtcacatcacccctgaagcctttgaaggtggtgtactggctgtggttaaagatggagatgaaatcttaattgatgcacaaaacaacgttttagagttattagttgagcaagcaattatcgataaacgtctatataattggacacaacccaaaccaaactacaccaaaggtgtattggctaaatttgcaaagttggctaaatctgcctctgaaggtgcagtgactgattag

SEQ ID NO: 174 - protein, 559 aa, Candidatus Ruthia magnifica
MRRKIMYNPRKYSSQVVDGFERAPSRAMLYPVGFTKEDFNKPQVGIASTWSMVTPCNMHINKLADETLKGVNATGGKAIIFNTITISDGISMGSEGMKYSLVSREVIADSIETVVGCQGFDGVVAIGGCDKNMPGCIIGLVRLNRPSIFVYGGTIQPGKNHTDVVSVFEAVGQFANHTIDAIELENIEKIAIPGPGSCGGMYTANTMASAIEALGMSLPNSSAQDAISDDKNNDCVQAGQAVLNLLNKDIKPRDIMTMKAFENAITVIIALGGSTNAVLHLIAMASAAEVNLKIDDFTRIGQKVPVIADLKPSGKYMMSELVKIGGTLPLMKMLLDAGLLHGDCLTVTGKTLAENLENVKPYADSQEIIRALDNPIKKDSHLRILRGNLATDGAVAKITGKEGLSFKGNAKCFSREEDALEAILNNQIITGDVIVIRYEGPVGGPGMREMLAPTSAVMGKGLGDKVALITDGRFSGGTHGFVVGHITPEAFEGGVLAVVKDGDEILIDAQNNVLELLVEQAIIDKRLYNWTQPKPNYTKGVLAKFAKLAKSASEGAVTD

SEQ ID NO: 175 - DNA, 1689 bp, Methylococcus capsulatus
atgaccgacaagcacccccgtccccattcgtcccaggtcgtcgacggcatggagcgcgccccgagccgcgcgatgctgcacgccgtcggcttcgccgatgccgacttcgccaaaccgcagatcggcatcgcttccacctgggcgatggtgacgccgtgcaacatgcacatcaacaagctcgccgaggacgcagcacgcggcgtcgacggcggcggcggcaaggcagtgatcttcaacaccatcaccatttccgacggcatctcgatgggcaccgaaggaatgaaatactccctcgtgtcgcgggaagtcatcgccgactcgatcgaaaccgtggtggcctgtcagggttatgacggcgtggtcgccatcggcggctgcgacaagaacatgcccggctgcctgatcgccctcgcccgcctcaaccgtccggcggtgttcgtctatggcggcaccatcctgccgggctgccacgacggcaagaagctggacgtggtgtcggtgttcgaagcggtcggcgcccgcgccaaccaccgcatcgacgatgccgaactgcacgccatcgaatccaatgccatccccggtccgggctcctgcggtggcatgtataccgccaacaccatggcctccgccatcgaggcattagggatgagcctgccgggcagttcggcccaggtggccatttcccgcgccaaggaactggattgcgagcgggccggcgcgcaggtcctcaagctcctggacctggggctcaaaccccgcgacatcatgaccaagaaggcgttcgagaacgccatcacggtggtgatcgccctgggcggctccaccaacgccgtgctgcacctcctggccatggccaacgcctgcggcgtcgacctgaagctcgacgatttcacccgcatcgggcgcaaagtgccgatgctggcggatctgaaacccagcggcagatactccatggccgaactggtggaaatcggcggcatccagccgctgatgaagaccttgctggacgcgggactcctgcacggcgactgcatgaccgtaaccggcaagaccctggaagaaaacctggccgacgcgcccgactacccggccggacaagacatgatccggtcgctggacaaccccatcaaaaaggacagccatctggtgatcctcaagggcaacctggcgccggaaggcgcggtcgccaagatcaccggcaaggaaggactgagcttcaccggcaccgcccgcgtattcgactgcgaggaagcggcgctcacggccatcctcgacggcacgatcgtgaaaggcgacgtcatcgtcatccgctatgaaggccccaagggcggccccggcatgcgcgagatgctctcgccgacctcggcggtcatgggcaagggattgggcaaggaggtcgccctcatcaccgacggccgcttttccggcggcacccacggcttcgtggtcggccacatcacgccggaagcctacaccggcggccccctggcgatcgtccgggacggcgataccatcaccatcgacgccgagacccgcgaattgagcctgcacgtcaccgacgatgaaatcggccggcgcctggcgcagtggactcaaccggcgccgcgctacaccaagggcgtgctggccaaatacgccaggttggtgagcccggcctcggaaggcgccgtcaccgacgacggcctctga

SEQ ID NO: 176 - protein, 562 aa, Methylococcus capsulatus
MTDKHPRPHSSQVVDGMERAPSRAMLHAVGFADADFAKPQIGIASTWAMVTPCNMHINKLAEDAARGVDGGGGKAVIFNTITISDGISMGTEGMKYSLVSREVIADSIETVVACQGYDGVVAIGGCDKNMPGCLIALARLNRPAVFVYGGTILPGCHDGKKLDVVSVFEAVGARANHRIDDAELHAIESNAIPGPGSCGGMYTANTMASAIEALGMSLPGSSAQVAISRAKELDCERAGAQVLKLLDLGLKPRDIMTKKAFENAITVVIALGGSTNAVLHLLAMANACGVDLKLDDFTRIGRKVPMLADLKPSGRYSMAELVEIGGIQPLMKTLLDAGLLHGDCMTVTGKTLEENLADAPDYPAGQDMIRSLDNPIKKDSHLVILKGNLAPEGAVAKITGKEGLSFTGTARVFDCEEAALTAILDGTIVKGDVIVIRYEGPKGGPGMREMLSPTSAVMGKGLGKEVALITDGRFSGGTHGFVVGHITPEAYTGGPLAIVRDGDTITIDAETRELSLHVTDDEIGRRLAQWTQPAPRYTKGVLAKYARLVSPASEGAVTDDGL

SEQ ID NO: 177 - DNA, 1662 bp, unknown
  uncultured marine bacterium EB80_02D08
atgacaaatagaaaatattcaaaagaacttttagatggaccaaatcaagcagcatcaagatcaatgcttagaggagtaggatttacatctgatgatttcaagaagccacttgtaggaattgcatcaactggggcaaaagttactccatgcaatatgcatattaatcagctgtcagaaattgttgagcattcagttgataattccggaggtaaaggagtgctattcaatactattacagtttctgatggtatatcaatgggaacacaaggcatgaaatactcactcgtttcaagagaagtcatagcagattctatagaaactgttgtgggctgtcttggttatgatggtgttatagcagttggtggatgtgataaaaatatgcccggatgtattatcggcatggcaaggcttaatagaccttccatatttatatatggtggctcaatcagacccagtgaagaaaataccgattatgtaactgtatgtgaaaagactggtgagttttctaaaggcgatctagacgaatctcaactaattcatgtagaaaaaatatctgtaaagggtcctggatcctgtggaggtatgtatacagccaatactatggcatctgctattgaggcattgggtatgagtcttcctggaagtagcagtcaagatgctgtctcaaatgataaagaagatgattgcataaaagctggtatagcgatcatgggcttattagaaaaagacatcaagccttcagacattatgacaaaaaaagcttttgagaattctataactatggtgattgctttaggcggttccacaaatgcagtacttcatttacttgctatggctgatgcaattggagttgatttaacgcttgatgactttacaagaatcggtaaaaagacgccagtcttagcagatttaaagccttttggctctcattatatgtctgagcttaatgcaaatggagggatacagccgctaatgaaaacccttttagataaaggcttacttcatggtgattgtcttactgttacagggaaaacactctcagaaaatctttctttagttaaaccttatgaattacatcaagatattatcaaggagtttgatagtccaataaaagctaatagtcatctcaggatactatatggaaatttagctgaagaaggagcggttgcaaaaataacaggaaaagagggaacttcttttgaaggtagcgctcgagtttttaattcagaggaagaaggcgttgaggctattttatcaaaatcaattaaacctggcgacgttgtagtaataagatatgagggaccaaaaggtggtcctgggatgagagaaatgttgaagcctacttcggcaatcatgggccaaggcctgggagataaagttgcatttattaccgatggtcgtttttcaggaggtactcatggttttgttgttggacacattacaccagaagcggcagatggtgggctaatagcaattattgaagatggtgattcaatactaattgatgcaaactcggataaactagtactgaatatctctgatgatgagatttcaactagacttagtaaatgggttaaccctaaaacgcctccaagaaaaggtgttctagcaaaatttgcacgaaatgttaaatcagcaagtcttggagcggtgacagattaa

SEQ ID NO: 178 - protein, 553 aa, unknown
  uncultured marine bacterium EB80_02D08
MTNRKYSKELLDGPNQAASRSMLRGVGFTSDDFKKPLVGIASTGAKVTPCNMHINQLSEIVEHSVDNSGGKGVLFNTITVSDGISMGTQGMKYSLVSREVIADSIETVVGCLGYDGVIAVGGCDKNMPGCIIGMARLNRPSIFIYGGSIRPSEENTDYVTVCEKTGEFSKGDLDESQLIHVEKISVKGPGSCGGMYTANTMASAIEALGMSLPGSSSQDAVSNDKEDDCIKAGIAIMGLLEKDIKPSDIMTKKAFENSITMVIALGGSTNAVLHLLAMADAIGVDLTLDDFTRIGKKTPVLADLKPFGSHYMSELNANGGIQPLMKTLLDKGLLHGDCLTVTGKTLSENLSLVKPYELHQDIIKEFDSPIKANSHLRILYGNLAEEGAVAKITGKEGTSFEGSARVFNSEEEGVEAILSKSIKPGDVVVIRYEGPKGGPGMREMLKPTSAIMGQGLGDKVAFITDGRFSGGTHGFVVGHITPEAADGGLIAIIEDGDSILIDANSDKLVLNISDDEISTRLSKWVNPKTPPRKGVLAKFARNVKSASLGAVTD

SEQ ID NO: 179 - DNA, 1599 bp, unknown
  uncultured marine gamma proteobacterium EBAC31A08
atgcttagaggagtaggtttcacatctgaggmtttcacaaaaccatttgttgggattgcttccacaggagcaaaagtaaccccatgcaatatgcacataaatgcactttcagagatcgttgagaaatcagttgatagttcaggaggaaagggtgttctttttaatactattactgtttccgatggaatttctatgggtacacagggtatgaaatattctcttgtttctcgagaggtaattgcagattcaatagaaactgttgtgggatgtcttggttatgatggagttattgctgtcggtggttgtgataaaaatatgcctggatgcattattggaatggcaagattaaatagaccatcaatatttatatatggtggttctatcaaacctagtaaagaaaataccgactatgttactgtttgtgagaaaactggagagtactcaaaaggcgatcttaaagaatctgaattaattcatgtagaaaaaatttccgtaaaagggcctggatcttgtgggggaatgtatacggcaaatactatggcttctgcgattgaagctctaggcatgagtcttcctggaagcagcagtcaagatgcaatttcacacgacaaagaagatgattgttttaaggctggcgaagcgataatgaatttattagaaaaagatattaagccttcagatattatgactaagaatgcttttgagaatgctataacaatggtaattgctctaggaggttcaactaatgcagttctgcatttattggccatggcgcattcaataggggttgatttagagctagatgactttacaagaataggaaaaaaaacacccgttatggcagatcttaagccctttggttctcattatatgtctgaactcaatgctaatggcggtattcagccactaatgaaaactttgcttgagaagggattactacacggcaattgtcttaccgttaccggtcagacgcttgctgaaaatctttctggaataaaaccttacgagcctgatcaagagataattaaatcatttgataatccaattaaatcaaatagccatcttagaattctgtatggcaacttagcgaaagatggtgcagttgcaaaaattacgggtaaagaaggaacttcctttgaaggaagtgctcgtgtatttgattcagaagaagaaggggttaaagcaatcctatctaaatctataaaagctggagatgttgttgtaattagatatgaagggccaaaaggaggtccaggcatgagagaaatgctaaaaccaacatctgccataatgggtcaaggtcttggcgatcaggtagcttttataacagacggtcgtttttcaggaggcactcatggatttgttgttgggcacattactccagaggctgcagatggcggcttaattgcaataattaaagatggcgactctatattaattgatgcagattctgataagttaattcttaatatttctgaggatgaaatttcaaatagactaagtagatgggtaaacccaaaaacgcctcccaaaaaaggagtcttagcaaaatttgcaaaaagtgttaaatcagctagtcttggagcggtaacagattaa

SEQ ID NO: 180 - protein, 532 aa, unknown
  uncultured marine gamma proteobacterium EBAC31A08
  misc_feature (11)..(11): Xaa can be any naturally occurring amino acid
MLRGVGFTSEXFTKPFVGIASTGAKVTPCNMHINALSEIVEKSVDSSGGKGVLFNTITVSDGISMGTQGMKYSLVSREVIADSIETVVGCLGYDGVIAVGGCDKNMPGCIIGMARLNRPSIFIYGGSIKPSKENTDYVTVCEKTGEYSKGDLKESELIHVEKISVKGPGSCGGMYTANTMASAIEALGMSLPGSSSQDAISHDKEDDCFKAGEAIMNLLEKDIKPSDIMTKNAFENAITMVIALGGSTNAVLHLLAMAHSIGVDLELDDFTRIGKKTPVMADLKPFGSHYMSELNANGGIQPLMKTLLEKGLLHGNCLTVTGQTLAENLSGIKPYEPDQEIIKSFDNPIKSNSHLRILYGNLAKDGAVAKITGKEGTSFEGSARVFDSEEEGVKAILSKSIKAGDVVVIRYEGPKGGPGMREMLKPTSAIMGQGLGDQVAFITDGRFSGGTHGFVVGHITPEAADGGLIAIIKDGDSILIDADSDKLILNISEDEISNRLSRWVNPKTPPKKGVLAKFAKSVKSASLGAVTD

SEQ ID NO: 181 - DNA, 1659 bp, unknown
  uncultured marine gamma proteobacterium EBAC20E09
atgagctctagaaaatattcaaaagaccttgttgatggcccaaatcaagctgcatcaagatcaatgctgcgtggggttggatttactactgaagatttttcaaaatcttttgtaggcattgcatcaacaggtgcaaaagttacaccgtgtaatatgcatatcaataaacttgcagaagttgttgagaattcggtgaatgtatctggaggtaaaggagtactttttaatactattactgtatcagacggcatatcaatgggaactcaaggcatgaaatattctcttgtatcaagagaggttatagctgattcaattgaaacagttgttggttgtttaggttatgatggcttaatcacaattggtggctgtgataagaacatgcctggctgtttgataggcatggcaagattgaaccgaccatccattttcatttatggggggtcaattaagccaagtaatgaaaaaaccgactatgtcacagtatcagaaaaggttggtgaattctccaaaggcgacattgatgaaaaagaactcattcattatgaaaaaatttcagtagaaggcccaggatcatgcggtggtatgtataccgcaaatacaatggcttcagctatcgaagctttaggaatgagtttaccaggcagcagcagtcaagatgcagtttcaaaatctaaaaatgaagattgcatttctgcaggaatagccataatgaatttgcttgaaaaagatttaaaaccctctgacattatgacaaaggaggcttttgaaaatgcaattacagttgttattgcattaggtggatcgacaaatgctgttcttcatttattagctatggctcatgccgtaggtgtcgaacttcaattggatgattttacaaaaattggaaaactcactccggtacttgcagacctcaaaccatttggtaatcattttatgtctgagttaaatgcaaacggtggaatacagccactaatgaaaagtttattagataaaggaatgctgcatggaaattgtttgacggttactggtaattcattagaagaaaatttaaaagatatagagccgtataaagatgaaaaaataataaaaagcttagataatccaattaaatctgatagtcatttaagagtgttatatgggaacttagctaaggatggcgctgttgcaaaaattacaggaaaggagggcttttcatttgaaggcaaagccaaagtatttaactcggaagaagatggagttcaggcaatccttgcaaaaaaaattgttccaggtgatgtagttgtaattagatatgagggaccaaaaggtggtccgggcatgagagaaatgttaaagccaacatctgcgatcatggggttaggcttaggagataaagttgcttttataactgacggtagattttctggaggaactcatggatttgttgtgggccatgtatctccagaggcagcagatggaggcctaattgctttaatcaaagatggagacaatatcttgatagatgcagaaaatgatgaattaatactaaaggttgatcaagacgaaattgatttaagaaagaagaactggaaaaatcctactaatcctcctaaaaaaggagttcttgcaaagtatgctgcaagtgtaaaatctgccagcttaggagcaattactgattaa

SEQ ID NO: 182 - protein, 552 aa, unknown
  uncultured marine gamma proteobacterium EBAC20E09
MSSRKYSKDLVDGPNQAASRSMLRGVGFTTEDFSKSFVGIASTGAKVTPCNMHINKLAEVVENSVNVSGGKGVLFNTITVSDGISMGTQGMKYSLVSREVIADSIETVVGCLGYDGLITIGGCDKNMPGCLIGMARLNRPSIFIYGGSIKPSNEKTDYVTVSEKVGEFSKGDIDEKELIHYEKISVEGPGSCGGMYTANTMASAIEALGMSLPGSSSQDAVSKSKNEDCISAGIAIMNLLEKDLKPSDIMTKEAFENAITVVIALGGSTNAVLHLLAMAHAVGVELQLDDFTKIGKLTPVLADLKPFGNHFMSELNANGGIQPLMKSLLDKGMLHGNCLTVTGNSLEENLKDIEPYKDEKIIKSLDNPIKSDSHLRVLYGNLAKDGAVAKITGKEGFSFEGKAKVFNSEEDGVQAILAKKIVPGDVVVIRYEGPKGGPGMREMLKPTSAIMGLGLGDKVAFITDGRFSGGTHGFVVGHVSPEAADGGLIALIKDGDNILIDAENDELILKVDQDEIDLRKKNWKNPTNPPKKGVLAKYAASVKSASLGAITD

SEQ ID NO: 183 - DNA, 1659 bp, unknown
  uncultured gamma proteobacterium eBACHOT4E07
atgagctctagaaaatattcaaaggaattagttgatggtccaaatcaggccgcatctcgttctatgcttcgaggtgtaggatttacatctgaggactttacaaagccatttgttggaattgcatcaactggagccaaagttacaccatgtaatatgcatatcaatcaattatcagaattggtagaagactcaataaatgcatctggtggcaaaggtgttttatttaatacaattactgtttctgatggcatttcaatgggaacgcaaggaatgaaatattctcttgtttcaagagaagttattgctgactcaattgaaactgttgtaggttgccttggatatgatggattaattgcaattggtggatgtgataagaacatgcctggatgtcttattggtatggcaagattaaatagaccgtcaatatttatttatggtggatctataaaaccaagtaatgagaatacggactatgtcactgtctcagaaaaagttggagaattctcaaagggctctataaatgaagatgagctaattcattatgaaaagatatcagttgatggaccaggctcatgtggcggaatgtatacagcaaatacaatggcatctgccatagaggcattaggaatgagtttgccaggtagcagtagccaagatgcaacatctaaatcaaagaacgctgattgtgtgaatgctggatcggcaatcatgaatttactagataaagatattaaaccttctgacattatgacaagagaagcatttgaaaatgctataactgttgtaatagctctaggaggatcaacaaatgccgttcttcatttattggccatggctcattcaattggagttgaactttgcttagatgactttacttcaattggaaagaaaacacctgtattagcggacctaaaaccctttggaaaacactatatgtctgagcttaatgcaaatggaggaattcagcccttaatgaaaactcttttagacaaaggacttcttcatggtcaatgtatgacagttacaggcaataccttagaagaaaatttaaaagacataaaagcatatgagacgagtgaaataattaaagattttaataatccaatcaaaaaagatagtcatcttagaattttatacggcaaccttgctaaagatggcgcggttgcaaaaattacaggtaaagaaggaacatcttttgaaggaaaagcaaaagtatttaattcagaagaagagggcgtaagtgcgattctatcaaatcagattaatgatggtgatgtaatcgtaataaggtatgagggtccaaagggtgggcctggcatgagagaaatgctaaaacctacttctgcaatcatgggattaggactaggagataaaataggatttattacagatggaagattttcaggtggcacccatggttttgtagttggacatgtttctccagaagcagctgagggtggtttaatagcattagttgaagatggagatactatacttattgatgcagaaagtgatcagcttgttctaaaagttgatgatgatgaaattaaaagaagacaatcaatttggaaaaatccaaacagtaaaccaaaaaaaggagtacttgctaagtatgctgagagcgtaaaatctgcaagcctgggagctataactgattaa

SEQ ID NO: 184 - protein, 552 aa, unknown
  uncultured gamma proteobacterium eBACHOT4E07
MSSRKYSKELVDGPNQAASRSMLRGVGFTSEDFTKPFVGIASTGAKVTPCNMHINQLSELVEDSINASGGKGVLFNTITVSDGISMGTQGMKYSLVSREVIADSIETVVGCLGYDGLIAIGGCDKNMPGCLIGMARLNRPSIFIYGGSIKPSNENTDYVTVSEKVGEFSKGSINEDELIHYEKISVDGPGSCGGMYTANTMASAIEALGMSLPGSSSQDATSKSKNADCVNAGSAIMNLLDKDIKPSDIMTREAFENAITVVIALGGSTNAVLHLLAMAHSIGVELCLDDFTSIGKKTPVLADLKPFGKHYMSELNANGGIQPLMKTLLDKGLLHGQCMTVTGNTLEENLKDIKAYETSEIIKDFNNPIKKDSHLRILYGNLAKDGAVAKITGKEGTSFEGKAKVFNSEEEGVSAILSNQINDGDVIVIRYEGPKGGPGMREMLKPTSAIMGLGLGDKIGFITDGRFSGGTHGFVVGHVSPEAAEGGLIALVEDGDTILIDAESDQLVLKVDDDEIKRRQSIWKNPNSKPKKGVLAKYAESVKSASLGAITD

SEQ ID NO: 185 - DNA, 1686 bp, Alcanivorax borkumensis
atgagtgactcaaagggcgatccgcgtcgccgccattcagcaaaggtcgtggacggccccggtaaatccgccagccgggccatgctgcgggcggtggggtttaccgatgaggattttcataaaccccaggtgggcattgcttctacttggagtcaggtgacgccgtgcaatagccatatcggtgagctcgccgaaaaagcctgcgctggagccgatgcggccggcggcaaaggggtaattttcaataccatcaccatctccgatggcatcgccaatggtaccgaagggatgaagtattcgttggtctcccgcgaggtgattgccgattccattgaaaccgtggcggcttgtgaaggctttgacggcctggtagctcttggtggctgcgataagaacatgcccggttgcctaatgggcatggcgcggctgaatcgccccagcgtctttgtctacggcggcaccatcatgcccggcaagggccacacggatattgtttctgtgttcgaagccatgggagcccattcccgcggcgacatggacaaaatcgaactcaagcagatagaagaaactgccattcccgggcccggtgcttgcggcggcatgtacacggccaacactatggcctcggctattgaagcgctgggcatgagcctgccgggcagctccgcacagaatgcggtgtcggaagagaagcgtgatgattgccagcgcgccggcgaagcagtgttggcgctactggaacaggacatcaagccctcggacatcatgacgcgggctgcatttgagaacgccatcactgtggtgatcgccctgggcggttccaccaatgcggtgctgcacctgatcgccatggcgcgcaccgtgggggtgccgctgtcgctggatgactttaccgagatcggcaggcgggtgccggtgctggcggacctgcgccccagtggccattacatgatgagcgagttggtggccatcggcggtattcagccgttgatgaaggtgctgttggaggcgggtttgctgcagggtgattgcctgacggtcaccggccgtaccttggctgagaacctggcggatgtcagtccttatccactggatcagacgatcatcgcgccactgtctgcgccgctgaaagcagaaagtcacctgcgcatcctttatggcaatttggcgccggatggcgcagtggccaagatcaccggcaaggaaggcacccacttttccggcccggcccgggtgttcggttcggaagaagaagcgcagcagcggatcaatgatgggactgtggtgtccggggacgtggtggtgatccgctatgaaggcccccgcggcggcccaggcatgcgtgaaatgctcacccccacctctgccatcatggggcgcggcctgggtgacgaggtggcgctgattaccgatggtcgcttttccggcggcagccatggtttcgtggtaggccacgtgaccccagaagctttcgatggtggtccgctggcattattggaaaacggtgaccaaattaccattgatgccgaagccaacaccctggtcgtggcgctgtctgatgcggagttggcgcgccgccgtgctaactggcaacagccagcaccacgctatacccgtggtgtgctggccaaatacgcacggctggtgggttcggccagcgaaggcgcgctgacggacttaggttaa

SEQ ID NO: 186 - protein, 561 aa, Alcanivorax borkumensis
MSDSKGDPRRRHSAKVVDGPGKSASRAMLRAVGFTDEDFHKPQVGIASTWSQVTPCNSHIGELAEKACAGADAAGGKGVIFNTITISDGIANGTEGMKYSLVSREVIADSIETVAACEGFDGLVALGGCDKNMPGCLMGMARLNRPSVFVYGGTIMPGKGHTDIVSVFEAMGAHSRGDMDKIELKQIEETAIPGPGACGGMYTANTMASAIEALGMSLPGSSAQNAVSEEKRDDCQRAGEAVLALLEQDIKPSDIMTRAAFENAITVVIALGGSTNAVLHLIAMARTVGVPLSLDDFTEIGRRVPVLADLRPSGHYMMSELVAIGGIQPLMKVLLEAGLLQGDCLTVTGRTLAENLADVSPYPLDQTIIAPLSAPLKAESHLRILYGNLAPDGAVAKITGKEGTHFSGPARVFGSEEEAQQRINDGTVVSGDVVVIRYEGPRGGPGMREMLTPTSAIMGRGLGDEVALITDGRFSGGSHGFVVGHVTPEAFDGGPLALLENGDQITIDAEANTLVVALSDAELARRRANWQQPAPRYTRGVLAKYARLVGSASEGALTDLG

SEQ ID NO: 187 - DNA, 1713 bp, Chromohalobacter salexigens
atgagccagcaggactcccccgccaacgccgatcaccgtcgccgccattcctccatcgtggtcgacggccccggcaaggccgccagtcgcgccatgctgcgtgccgtcggtttcaccgacgaggatttcaagaagccgcaggtggggatcgcctcgacctggagtcgcgtcacgccgtgcaacagccacatcaacgtgttggccgatgccgccagtgacggcgccgacgccgccggtggcaagggcgtggtcttcaataccatcaccatcagcgacggcatcgccaacggcaccgaaggcatgaagtattcgatggcctcgcgcgagatcatcgccgattccatcgaggcggtctccggctgcgaggggttcgacggggtggtggccatcggtggctgcgacaagaacatgcccggctgcatgatcggcctggcacgtctcaaccggcccagcatcttcgtctacggcggtaccatccagcccggtgccgggcacaccgacctggtctcggtattcgaggcgatgggcgcctactcccagggcaacaagtcgctgatcgaggtcaagcagatcgaggaagtcgcgattcccgggccgggctcctgtggcggcatgtacaccgccaacaccatggcctcggcgatcgaggccatgggcatgagcctgcccaattcgtcggctcaggacgcggtatcccagagcaagaaggacgatagtcgcgccgccggcgaggccgtgctcaagctgctcgaactggacatcaagccctcggacatcatgacccgcaaggcgttcgagaacgccatcaccgtggtcatcgccctcggcggttccaccaatgccgtgctgcacctgattgccatggccaacaccatcggggtcgagctctcgctcgacgactttaccgagatcggcaagcgcgtcccggtgctcgccgacctgcgccccagcggtcattatctgatgagcgagctggtggcgatcggcggcattcagccgatgatgaagattctgctcgatgcggggctgctccacggcgattgcctgaccgtgaccggcaagacgctggccgagaacctggccgacgtgacgccttatccgacggggcaggaaatcatcaagccgctggaggcaccgatcaaatcgagcagccacctgcgcattctctacggcaacctggcgccagagggagcggtggccaagatcaccggcaaggaaggtacccgcttcaccgggcgtgctcgcgtgttcaactccgaggaggaggcccaggcgcgcatcaacgacctgaccgtggccgccggtgacgtcgtcgtgattcgctacgaggggccgaagggcggtcccggcatgcgcgaaatgctgacgccgacctcggcgatcatgggccgtggcctgggcgacaaggtggccttgatcaccgatggacgcttctccggcggcagccatggcttcgtggtcggtcacatcacgccggaagccttcgtcggcggccccatcggcctggtcgaggacggtgacgagatcaccatcgacgccgagaacgacatcatgacgctgcatatcgacgacgccgagatggcgcgccgccgtgcggcctggaagcgcccggcaccgcgttatacgcgcggcacgctggccaagtacgccaagacggtcagctcggcatcgaaaggggcggtcaccgatctgcccgaagcgctggacgattga

SEQ ID NO: 188 - protein, 570 aa, Chromohalobacter salexigens
MSQQDSPANADHRRRHSSIVVDGPGKAASRAMLRAVGFTDEDFKKPQVGIASTWSRVTPCNSHINVLADAASDGADAAGGKGVVFNTITISDGIANGTEGMKYSMASREIIADSIEAVSGCEGFDGVVAIGGCDKNMPGCMIGLARLNRPSIFVYGGTIQPGAGHTDLVSVFEAMGAYSQGNKSLIEVKQIEEVAIPGPGSCGGMYTANTMASAIEAMGMSLPNSSAQDAVSQSKKDDSRAAGEAVLKLLELDIKPSDIMTRKAFENAITVVIALGGSTNAVLHLIAMANTIGVELSLDDFTEIGKRVPVLADLRPSGHYLMSELVAIGGIQPMMKILLDAGLLHGDCLTVTGKTLAENLADVTPYPTGQEIIKPLEAPIKSSSHLRILYGNLAPEGAVAKITGKEGTRFTGRARVFNSEEEAQARINDLTVAAGDVVVIRYEGPKGGPGMREMLTPTSAIMGRGLGDKVALITDGRFSGGSHGFVVGHITPEAFVGGPIGLVEDGDEITIDAENDIMTLHIDDAEMARRRAAWKRPAPRYTRGTLAKYAKTVSSASKGAVTDLPEALDD

SEQ ID NO: 189 - DNA, 1677 bp, Marinobacter algicola
atgacagaagacaaacgccgccgttattccgcgcccgtggtcgatggcctgggcaagtcggcaagccgcgccatgttgcgggccgtggggtttaccgatgaagatttccgcaaaccccagatcggtattgcctcgacctggagcaacctgacgccctgcaatatgcacatcaaccaactggcggaggaatcggccgcgggtgccgacgaggccgggggcaagagcctgacgttcaataccatcaccgtttccgacggcatcgccaacggcacggagggtatgaagtactccctggtgtcgcgggaagtcattgccgactccattgaaaccgtggctggttgtgaaggttttgatggcctggttgccattggcggctgcgacaagaacatgcccggctgcatgatgggcctggcgcgcctgaaccggccgtcggtatttgtctatggcggcaccatcatgcccggcgagaatcacaccgacatcatctcagtatttgaggcggtgggtgcccatgcccggggtgacctggacctgattgaggtcaaacagatcgaggaaaccgcgattccggggccaggctcctgcggcggcatgtacaccgccaacactatggcctcggcgattgaagccatgggcatgagcctgccgggcagttccgcccagaacgctgtttccgagaccaaggcggccgactgcagggcggcgggcgcggccgtcctcaacctgctggagaaagatctcaagccatcggacatcatgacccgggaggcgttcgagaatgctatcaccgtggtaattgccctgggtggctccaccaacgcggtgctgcacctgattgccatggccagcaccgttggcgttgacttgacgctggacgacttcgtggaaatcggcaaacgggttcccgtattggcagatctgcgccccagcggtcactacatgatgtcggaactggtggcgatcggcggcattcagccgttgatgaagatgctgctcgaccgtggcatgctccatggcaactgcatgaccgtcaccgggcagacactggcggacaacctgaaagacgtggctccgtacccggcaagccaggacatcattcatgcctttgatgaccccatcaaggcggatagccatctgcgtatcctttacggcaacctggcgcctactggtgcggtggccaagatcactggtaaggagggtacccatttcaccggccgtgcacgggtgttccagtccgaggaagaggcccaggagcggatcatggacggcaccgttgtggccggagacgtgttggtgatccggtttgaaggccccaaaggtgggccgggcatgcgggagatgctaacgccgacttctgccatcatgggtaaagggctgggcagcgatgtggcgctgattaccgacgggcgtttttccggtggcagccacggtttcgtggttggtcatattacgccggaggccgcagaaggtgggccgattgcgctggtggaaactggcgacaccatcaccattgatgcagtggccaatcgcattgagctggatgtttcggagcaggaaatggagcgccgccgacaggcatggaccgcaccggctccccgatttacccgcggggtgctggccaaatacgcgcgcaccgtgagttccgcttcggaaggcgcagtgacagacaagccgtga

SEQ ID NO: 190 - protein, 558 aa, Marinobacter algicola
MTEDKRRRYSAPVVDGLGKSASRAMLRAVGFTDEDFRKPQIGIASTWSNLTPCNMHINQLAEESAAGADEAGGKSLTFNTITVSDGIANGTEGMKYSLVSREVIADSIETVAGCEGFDGLVAIGGCDKNMPGCMMGLARLNRPSVFVYGGTIMPGENHTDIISVFEAVGAHARGDLDLIEVKQIEETAIPGPGSCGGMYTANTMASAIEAMGMSLPGSSAQNAVSETKAADCRAAGAAVLNLLEKDLKPSDIMTREAFENAITVVIALGGSTNAVLHLIAMASTVGVDLTLDDFVEIGKRVPVLADLRPSGHYMMSELVAIGGIQPLMKMLLDRGMLHGNCMTVTGQTLADNLKDVAPYPASQDIIHAFDDPIKADSHLRILYGNLAPTGAVAKITGKEGTHFTGRARVFQSEEEAQERIMDGTVVAGDVLVIRFEGPKGGPGMREMLTPTSAIMGKGLGSDVALITDGRFSGGSHGFVVGHITPEAAEGGPIALVETGDTITIDAVANRIELDVSEQEMERRRQAWTAPAPRFTRGVLAKYARTVSSASEGAVTDKP

SEQ ID NO: 191 - DNA, 1677 bp, Marinobacter aquaeolei
atgacaaccgataaacgacgccgacactcggcaccggtggtagacggtatcaataaatccgccagccgggccatgctccgggcggtaggttttaccgacgaggatttccgcaaaccccagattggcattgcctccacctggagcaaccttacgccctgcaacatgcacattgacggcctggcccgggaggccgccaagggtgccgacggagccgggggcaagagcctgatcttcaacaccatcactatctctgatggcatcgccaacggcaccgagggcatgaaatattccctggtgtcgcgcgaggtgattgccgattccattgagaccgtggccggttgtgagggcttcgacggactggtcgccatcggtggctgcgacaagaacatgcccggctgcatgatgggcctggcccggctgaaccggccctcggtcttcgtttacggcggcaccatcatgcccggcgagaaccataccgacatcatctccgtgtttgaggcggtgggcgcccatgcccgcggtaacatggagctgatcgaagtcaaacagatcgaggaaaccgcgattcccgggccaggctcctgtggcggcatgtacaccgccaacaccatggcctccgccattgaggccatgggtatgagcctgccaggcagctcggcccagaacgccatctccgacagcaaactggcggattgcgaagccgcaggcgccgcggtgctgaaactgctcgaagccgatatcaagccctccgacatcatgacccgggaagcgttcgagaacgccatcaccgtggtggtcgcgctgggcggttccaccaacgccgtgctgcaccttctgggtatggccagtaccgtgggagtggagctgtcactggacgatttcgtacgcatcggcaaacaggtaccagtcctggcggaccttcgcccctccggccactacatgatgtccgagctggtggccattggtggcattcaaccgctaatgaagatgctgctcgaccgggggctgctgcatggagactgcctcacggtaaccggcaaaaccctggcagagaatctcgagaccgtggtgccctaccccgaagaccagcagatcatccacgccttcgacaacccgatcaaagccgacagtcatctgcgtattctctatggcaacctggctccggaaggctcggtggcgaaaatcaccggtaaggaaggcacgcatttttccggtcgagcccgagtgtttcactctgaagaggaagcccaggagcgaatcctggatggcaccgtggtcgctggcgacgtgctggtgatccgatacgaaggcccgaagggcgggcctggcatgcgggaaatgctcagccccacctcggcgattatgggcaaaggtcttggcagtgatgtggctctgattacagacggccgcttctccggtggcagtcatggttttgtggttggccatatcacaccagaggccgccgtgggcgggccgattgcgctggtagaagacggcgacaccattaccattgatgccgtgagcaactcgattgtgctggaaatctctgacgaggaaatggaaaaacggcgcaaagcctggacgccgccggaacccagatttacccggggcgtgctggccaaatatgcccgtgtggtgagctctgcatctacgggggccgttaccgacctgccctag

SEQ ID NO: 192 - protein, 558 aa, Marinobacter aquaeolei
MTTDKRRRHSAPVVDGINKSASRAMLRAVGFTDEDFRKPQIGIASTWSNLTPCNMHIDGLAREAAKGADGAGGKSLIFNTITISDGIANGTEGMKYSLVSREVIADSIETVAGCEGFDGLVAIGGCDKNMPGCMMGLARLNRPSVFVYGGTIMPGENHTDIISVFEAVGAHARGNMELIEVKQIEETAIPGPGSCGGMYTANTMASAIEAMGMSLPGSSAQNAISDSKLADCEAAGAAVLKLLEADIKPSDIMTREAFENAITVVVALGGSTNAVLHLLGMASTVGVELSLDDFVRIGKQVPVLADLRPSGHYMMSELVAIGGIQPLMKMLLDRGLLHGDCLTVTGKTLAENLETVVPYPEDQQIIHAFDNPIKADSHLRILYGNLAPEGSVAKITGKEGTHFSGRARVFHSEEEAQERILDGTVVAGDVLVIRYEGPKGGPGMREMLSPTSAIMGKGLGSDVALITDGRFSGGSHGFVVGHITPEAAVGGPIALVEDGDTITIDAVSNSIVLEISDEEMEKRRKAWTPPEPRFTRGVLAKYARVVSSASTGAVTDLP

SEQ ID NO: 193 - DNA, 1692 bp, Marinobacter sp.
atgagtgataccccccaagaccctcgccgccgttattccgctccggttgtggacggtgtggctaaatccgccagtcgttccatgctgagggccgtcggttttaacgacgaagatttcagcaaaccgcagatcggcattgcttccacctggagtatggttaccccctgtaatagccacattaacgagctggccgacattgcttgtaagggtgcggaccaggccggtggtaaaggcgttatttttaacaccattacgatttctgacggcattgccaacggcaccgaaggaatgaagtattccctggtgtcgcgggaagtcatcgcagattccattgaaaccgtggccggttgcgagggttttgacggcctggttgccattggcggctgtgacaaaaacatgcccggctgcatcatgggcctggcgcggcttaaccggcccagcgtgtttgtttatggcggtactattttgcctggtgaaggtcacaccgacattatttcagtgtttgaagcggtgggcgcccatgccaaaggcgaactgtcgttgattgaagtgaagcatattgaagaaaccgccattcccggccccggttcctgtggcggcatgtacaccgccaataccatggcctcggccatagaagcactgggtatgagcctgcccggcagctcggcgcagaatgcggtgtcgaatgacaaaaaagccgattgcgaagccgccggtgccgcggtcatgaatctgttggatcgagatatcaaaccttccgacattatgactcagcacgcctttgagaacgccatcactgtgatcatcaccttgggtggttccaccaacgccgtactgcacctgattggtatggccaacacggcgggtgtagagctaaccctggatgacttcactcgcattggtaaaaaggttccattgttggcggatctgcgccctagcggccattacatgatgagcgaattggtggccattggcggcatccagccactcatgaaaatgctgctagacgccggcatgctccacggcgattgcctgacagtaaccggcaaaactctggccgaaaacctggccacggtagaaccttatgccgatggccagaaaatcattatgcctctggaccagcccattaaagcggaaagccacctgcgcattctgtttggtaatctggcgccggaaggctccgtggcaaaaattaccggtaaggaaggcacccactttaaaggtcgggcgcgggtgtttggttcggaagaagaagcccaagcacgaattctggacggcactgtggtggctggcgatgtgctggttatccgctatgaaggcccacgcggcggccccggcatgcgcgaaatgctgtcacccacctcggcgattatgggccgtgggctgggcagcgatgtggctttgataactgacggtcgtttctccggtggtagccacggcttcgtcgtaggccacattacgccggaagcgtttgatggcggccctattgccttggtgcaagacggcgacgaaatcgtgattgatgccgtggccgacactattgagctaaatgtcagtgacgacgaactgcagagccgtcgcgacgcctggcagcaaccgcaaccgcgttacacccgcggtgtgttagccaagtatgcgcgcaccgtgagttcggcgtcgaccggtgcagtgaccgacctgcccgagccttga

SEQ ID NO: 194 - protein, 563 aa, Marinobacter sp.
MSDTPQDPRRRYSAPVVDGVAKSASRSMLRAVGFNDEDFSKPQIGIASTWSMVTPCNSHINELADIACKGADQAGGKGVIFNTITISDGIANGTEGMKYSLVSREVIADSIETVAGCEGFDGLVAIGGCDKNMPGCIMGLARLNRPSVFVYGGTILPGEGHTDIISVFEAVGAHAKGELSLIEVKHIEETAIPGPGSCGGMYTANTMASAIEALGMSLPGSSAQNAVSNDKKADCEAAGAAVMNLLDRDIKPSDIMTQHAFENAITVIITLGGSTNAVLHLIGMANTAGVELTLDDFTRIGKKVPLLADLRPSGHYMMSELVAIGGIQPLMKMLLDAGMLHGDCLTVTGKTLAENLATVEPYADGQKIIMPLDQPIKAESHLRILFGNLAPEGSVAKITGKEGTHFKGRARVFGSEEEAQARILDGTVVAGDVLVIRYEGPRGGPGMREMLSPTSAIMGRGLGSDVALITDGRFSGGSHGFVVGHITPEAFDGGPIALVQDGDEIVIDAVADTIELNVSDDELQSRRDAWQQPQPRYTRGVLAKYARTVSSASTGAVTDLPEP

SEQ ID NO: 195 - DNA, 1680 bp, Pseudoalteromonas haloplanktis
atgacttctgaaaaaccacgtaaatattcacaaaaaattgtagatggtagcgctcaggctcctagtcgttctatgttacgagcggtaggttttaatgatgacgattttaaaaagtctcaagttggtattgcctctacatggtctatggtaacgccgtgcaatatgcacattaatacacttgccgaagaagtaggtaaaggcgtagatagcgccggtgcgaaaagcgttatatataataccattaccgtatccgatggtatttctatgggcaccgaagggatgaaatattctttagtatcacgcgaagtaatttgcgactcaatagaagcggtatcggcgggtatgggccacgacggtattattgctattggcggttgtgataaaaatatgccgggttgtttaatgggtttagcacgtttaaaccgcccctctatatttgtgtacggcggtacaattttacccggtgaaaatcataccgatatagtctcggtatttgaagcggtgggcagctacgcggcaggcgatattccaattacgcaattagaacatattgaaaaaacagccataccaggggctggttcgtgtggtggtatgtacacggcaaatacgttagcctcagcaattgaagctttaggcatgagtatgccaaatagttctgcgcaaaatgctatttcacaaaacaaaaaacaagactgtattgatgcgggtaaagcgattgtttatttgctagagcatgacattaaaccttccgatattatgaccaaaaaagcgtttgaaaatgcaattacgctgatcattaccttaggcggctcaaccaatgcggtgctgcatttaatcgctatggctgatgcggtaggcgttgaagtaacattggatgactttgtgcgtattggcgataaaacaccagtaattgccgacttgcgtcccagcggtcaatatttaatgtcggagttgattgaaattggtggcattcaaccactgatgaagcgtttattagatgccggtatgctgcacggtgactgtatgacagtgacaggcaaaaccatggccgaaaatttagccgatgtagcagattacccagcagggcaaaatattattttaccttttgataagccgattaaaaaagacagccatttagttatattagctggtaatttagcgccagaaggggcagtgtcaaaaattacgggtaaagagggtttacgctttaccggcaacgcaaaagtatatgactcagaagagcaaggttttgccgctattatagatgggcaagtagtagccggagacgttgtagtaattcgctatgaaggccctaaaggtggcccaggtatgcgtgaaatgctaagccccacttcagctattatgggtaaaggtttaggtaacgatgtggcgcttattaccgatggtcgtttttcaggtggtagtaggggttttgttgtggggcacgttacaccagaagcttacgaaggcggcgccattgcactagtagaaaatggtgacagcattactattgacgcgcaaagccgtgaaatgactcttaatattactgatgaagaaatggccagtaggaaacaacgttggcaacaacctgcgccaaaatacacccgcggattactagcaaaatatgccagaacagtaagttcagcttctaccggagccgtgaccgataagccaagttaa

SEQ ID NO: 196 - protein, 559 aa, Pseudoalteromonas haloplanktis
MTSEKPRKYSQKIVDGSAQAPSRSMLRAVGFNDDDFKKSQVGIASTWSMVTPCNMHINTLAEEVGKGVDSAGAKSVIYNTITVSDGISMGTEGMKYSLVSREVICDSIEAVSAGMGHDGIIAIGGCDKNMPGCLMGLARLNRPSIFVYGGTILPGENHTDIVSVFEAVGSYAAGDIPITQLEHIEKTAIPGAGSCGGMYTANTLASAIEALGMSMPNSSAQNAISQNKKQDCIDAGKAIVYLLEHDIKPSDIMTKKAFENAITLIITLGGSTNAVLHLIAMADAVGVEVTLDDFVRIGDKTPVIADLRPSGQYLMSELIEIGGIQPLMKRLLDAGMLHGDCMTVTGKTMAENLADVADYPAGQNIILPFDKPIKKDSHLVILAGNLAPEGAVSKITGKEGLRFTGNAKVYDSEEQGFAAIIDGQVVAGDVVVIRYEGPKGGPGMREMLSPTSAIMGKGLGNDVALITDGRFSGGSRGFVVGHVTPEAYEGGAIALVENGDSITIDAQSREMTLNITDEEMASRKQRWQQPAPKYTRGLLAKYARTVSSASTGAVTDKPS

SEQ ID NO: 197 - DNA, 1686 bp, Acinetobacter sp.
atgagtaaagacaatatacgccagtattcggcaccagtttatgacggtattgaaaatgcccctgcacgttcgatgatgcgtgctgtgggctttcaagataaagattttaatcgtccatttattggcattgcttcaacatgggccaatgtcacgccgtgcaacatgcacattgatggactggcacgagaagctgaacatggggtgaatcaggccagcggtaagggaattatttttaacactattaccatttctgacggtatttcaaacggtaccgaaggcatgaagtattctttggtttctcgtgaaattattgcagactctattgaggcggtcattggttgtcagggttacgatggtgtaattgccattggtggctgcgacaaaaacatgcctggctgtattatggggctggcacgtttgaaccgtccaggcttgtttatttatggcggcaccattcaaccaggtgaaggacataccgacatgatttcggtgtttgaagcggtgggacagtacgccaaaggagaaatcaatgccattcaggtcaagcagattgaagaagtcgctttaccaggaccaggttcttgcgggggaatgtataccgccaataccatggcttctgctattgaagcactgggaatgagtttaccaggttcttctgcacaggatgccatttctgaagaaaagcgtcaggactgtcatcgtgcgggcgaggcggtgatgaacctgcttcggctggatattcgtccacgcgatattatgaccaaagcggcatttgagaatgccattaaggtcgtcattgctttgggcggttcaaccaatgccgtattgcatttgattgcaatggcacatacggctgaggtaaagcttgatctggatgattttgtacgaattggtcaggaaacacctgtggtggcagatttacgaccatcgggtaagtatctcatgtccgaactgatcaagattggtgggattcagccgttgatgaagcgaatgctggaacgcggcatgctggatggtagttgtctgactgtaactggtaagacccttgcagagaatttggccgaggttgaggattatcctgccgatcaacaaattatcttgccatttgagcaacctgttaagaaagactcccatctagtgattcttaagggtaatttgtccccgacaggtgccgttgccaaaattacgggcaaagaaggtttatattttgaagggccagcccgcgtttttgaaggcgaagaaggcgccatgcgtggcattctagacggagaagtacaagagggcgaagttgtcgtcattcgtggtgaaggacccaaaggtggaccaggcatgcgcgaaatgctgaaaccaacgtctgcaattattggtaaaggactgggacaatcggtggcgctgattaccgatgggcggttttcgggcggcagtcatggctttgtcattggccatgtgaccccagaagcttacgaaggtgggcctattggtttggttgaaaatggtgataaaatttcaatcaatgctgaaacgcgtgaaatcaccttacatatttctaacgaagaaatgagcttacgtcgtgcaaaatggcagaaaccagaaccaaaatataaatctggtgctttggcaaaatttgcaaaacttgcagcaggtgcggacaaaggcgcagttactgatttaaatcttgatgtgtaa

SEQ ID NO: 198 - protein, 561 aa, Acinetobacter sp.
MSKDNIRQYSAPVYDGIENAPARSMMRAVGFQDKDFNRPFIGIASTWANVTPCNMHIDGLAREAEHGVNQASGKGIIFNTITISDGISNGTEGMKYSLVSREIIADSIEAVIGCQGYDGVIAIGGCDKNMPGCIMGLARLNRPGLFIYGGTIQPGEGHTDMISVFEAVGQYAKGEINAIQVKQIEEVALPGPGSCGGMYTANTMASAIEALGMSLPGSSAQDAISEEKRQDCHRAGEAVMNLLRLDIRPRDIMTKAAFENAIKVVIALGGSTNAVLHLIAMAHTAEVKLDLDDFVRIGQETPVVADLRPSGKYLMSELIKIGGIQPLMKRMLERGMLDGSCLTVTGKTLAENLAEVEDYPADQQIILPFEQPVKKDSHLVILKGNLSPTGAVAKITGKEGLYFEGPARVFEGEEGAMRGILDGEVQEGEVVVIRGEGPKGGPGMREMLKPTSAIIGKGLGQSVALITDGRFSGGSHGFVIGHVTPEAYEGGPIGLVENGDKISINAETREITLHISNEEMSLRRAKWQKPEPKYKSGALAKFAKLAAGADKGAVTDLNLDV

SEQ ID NO: 199 - DNA, 1737 bp, Opitutaceae bacterium
atgaagccgacgaccgccaagaccaagcctgccacagccgccaagaccgccaacgccacgcgccagttctcctccatcgtgcacgacggagccgaccgcgcccccaatcgctccatgctccgcgccgtcggattcggcgatgcggatttcaagaaaaccgtcgtcggcgtcgcctccacctggtcgatgctcaccccgtgcaacatgcacatcaacaagctcgccgaatacgccgagcagggcgccaacgaagccggcggcaagggcatcatcttcggcaccatcaccatcgccgacggcatcagcatgggaacgcccggcatgcgctactcgctcgtgtcccgcgaagtcattgccgactccatcgaaaccgtggttggcggcgaaggttttgacggccttgtcgccatcggcggctgcgacaaaaacatgcccggctgcgttatggccatggcccgtctcaaccgccccagcgttttcgtttacggcggcaccattcttcccggcatccacccggaaaccaaaaaggacctcgacatcgtttccgtcttcgaagccgtcggccagcacgccgcgggcaagatcaacgacgctgcgctcaaggttgttgaggaatgctccatccccggtcccggttcctgcggcggtatgtataccgccaatacaatggccaacgccatcgaagccctcggcctctcgctgcccaattcctccgcgcaaatcgccatctccaaggaaaaacaagaagactgtcgccgcgccggagccgctgtcgttgaactcgcaaaaaaggggattcgtccgcgtgacattttaaccaaaaaagcctttgaaaacgccatcactgtagtgatcgccctcggtggctcaaccaatgccgtcctgcacctcctcgccatcgcgcacactgccggcgtgaagctcaccatcgacgacttcacccgcatcggcaaacgcgtgcccgtgctcgccgatctcaaaccttcgggcaaatacggcatggtgcatctctctcgcatcggcggcgtgcctccgctcatgaagaccttgctcgaccgcggtctcatccacggcgactgcctcaccgtcaccggcaagaccgtggcggaaaacctcaaggacgtgcagccgtatccagaaaatcaggacgtgatccgtccctttgaccaaccgatcaagcccgacagccacctgcgcattctctacggcaacctcgccgccgagggttccgtggccaagatctccggcaaggaaggcttaaagttttccggcaaagccatcgtgttcgagggagaggaggccgcgttgtctgccatcctcgacggacgcgtgaagtccggccacgtcgtcgtgatccgcaatgagggtcccgtgggcggccccggcatgagggagatgctcgcccccaccagcgccatcatgggcaagggactcggcaaggaagtcgcgctcatcaccgacggacgtttttcgggcggttcgcacggatttgtggtcggccacatcacacccgaggcggcgattggcggcaccatcggcgtcgtgaaaaacggcgacccgatcaccatcgacgccgtaaaaaaccagatcacgctcgacattcccgcgaaggaaatcgccgcgcgcaaaaagacctggaagccacgcaagccctacaccaatcgcggtgtgttggcgaagtatgccaaactcgtcagcaccgccagcgaaggcgcggtgacggacaagtatttgtaa

SEQ ID NO: 200 - protein, 578 aa, Opitutaceae bacterium
MKPTTAKTKPATAAKTANATRQFSSIVHDGADRAPNRSMLRAVGFGDADFKKTVVGVASTWSMLTPCNMHINKLAEYAEQGANEAGGKGIIFGTITIADGISMGTPGMRYSLVSREVIADSIETVVGGEGFDGLVAIGGCDKNMPGCVMAMARLNRPSVFVYGGTILPGIHPETKKDLDIVSVFEAVGQHAAGKINDAALKVVEECSIPGPGSCGGMYTANTMANAIEALGLSLPNSSAQIAISKEKQEDCRRAGAAVVELAKKGIRPRDILTKKAFENAITVVIALGGSTNAVLHLLAIAHTAGVKLTIDDFTRIGKRVPVLADLKPSGKYGMVHLSRIGGVPPLMKTLLDRGLIHGDCLTVTGKTVAENLKDVQPYPENQDVIRPFDQPIKPDSHLRILYGNLAAEGSVAKISGKEGLKFSGKAIVFEGEEAALSAILDGRVKSGHVVVIRNEGPVGGPGMREMLAPTSAIMGKGLGKEVALITDGRFSGGSHGFVVGHITPEAAIGGTIGVVKNGDPITIDAVKNQITLDIPAKEIAARKKTWKPRKPYTNRGVLAKYAKLVSTASEGAVTDKYL

SEQ ID NO: 201 - DNA, 1683 bp, Flavobacterium sp.
atggaattaaataaatacagtaaaactgtaactcaagacccaacattgcctgcggctcaagcaatgctgcacgcaataggtttaaccgatgaagatctcaagaaaccattaattggtatcgcaagtactggttatgaggggaatccttgtaatatgcaccttaatgatttggcaacctacgtcaagaaaggtgcgtctaatgcagatttagtcggacttattttcaatacgatcggtgtaagtgatggtatttctaacggaactccgggaatgcgtttctcgctgccgtcacgtgatatcatcgctgattctatggaaaccgtggttcaagcaatgagttatgacggtctggttacagttgtgggctgtgataaaaatatgccgggggcattaattgcgcaattgcgattaaatcgcccgtcaattttagtttatggaggaacgatcgcttccggatgccataacggaaaaaaactagatatcatttctgcttttgaggcttatggtcaaaaagttgcaggaactattgatgataatgagtttaaagaagtagtacacaaagcgtgtccgggtgccggtgcttgtggtggtatgtatactgcaaatactatggcttctgctattgaagctttaggaatgtcattgccttttaactcatcgaaccctgcagttactgatgctaatattaaagagcaggaatgtattaaagcaggtgaggctttaaaatatttattagagcaggatattaaaccttcagatattgtaacaaaagagtcgctcgagaatgcgattcgcttggtgactgttttgggaggttctaccaacgcagtattgcactttttagcaatagctaaagcagctcaggtagattttacgctagaagattttcagcgcctgagtgataatacaccgttgttagcagatcttaaaccttcaggtaaatattctatggaagatttacacggtgttggcggaattccgggagtattaaaatatatgcttgataacggtatgcttcacggggattgtttaaccgttaccggaaaaactttagctgaaaacctaaaagatgttcccaatcttatagatggtcaggatattattagaccgttgaataagccaattaaagatagtggccatatccgtatactattcgggaacttggctactgaaggagctgtagcaaagattaccggtaaggaagggctttcgtttacaggaactgccaatgtattcaacagcgaattagaggtaaacgaaggaattaaatcaggaaaagttaaaaaaggtgacgtagtgatcattcgctatgaaggacctaaaggtggtcccggaatgccagaaatgcttaagcctacctcttcaattatgggagccggtttaggtaaagacgttgctttgattactgacggaagattctctggtggatcgcacggatttgtggtggggcacgtttctcccgaagcacaagtgggtggaaatatcgcacttgtagaaaatggagatgtcatttctattgatgccgtaaagaataccatcaacatcgatattaccgatgaagaattggcaaaacgaagagaaaaatggacagctccggaacttagattccaacgcggagcgttatataaatatgcgaaaacagtctcgtcagcttctaaaggttgtgtgacagacgaaatgtag

SEQ ID NO: 202 - protein, 560 aa, Flavobacterium sp.
MELNKYSKTVTQDPTLPAAQAMLHAIGLTDEDLKKPLIGIASTGYEGNPCNMHLNDLATYVKKGASNADLVGLIFNTIGVSDGISNGTPGMRFSLPSRDIIADSMETVVQAMSYDGLVTVVGCDKNMPGALIAQLRLNRPSILVYGGTIASGCHNGKKLDIISAFEAYGQKVAGTIDDNEFKEVVHKACPGAGACGGMYTANTMASAIEALGMSLPFNSSNPAVTDANIKEQECIKAGEALKYLLEQDIKPSDIVTKESLENAIRLVTVLGGSTNAVLHFLAIAKAAQVDFTLEDFQRLSDNTPLLADLKPSGKYSMEDLHGVGGIPGVLKYMLDNGMLHGDCLTVTGKTLAENLKDVPNLIDGQDIIRPLNKPIKDSGHIRILFGNLATEGAVAKITGKEGLSFTGTANVFNSELEVNEGIKSGKVKKGDVVIIRYEGPKGGPGMPEMLKPTSSIMGAGLGKDVALITDGRFSGGSHGFVVGHVSPEAQVGGNIALVENGDVISIDAVKNTINIDITDEELAKRREKWTAPELRFQRGALYKYAKTVSSASKGCVTDEM

SEQ ID NO: 203 - DNA, 1680 bp, Cellulophaga sp.
ttgaaagaacttaataaatatagtaaagcggtaactcaagatcctacgcagccagctgctcaggcaatgttgcacgctataggacttacagatgaagattttaaaaagccacttgtaggtattgcaagtacaggttatgagggtaatccttgtaatatgcacttaaataaccttgcactagatattaaaaaaggagtacaaacttctgatctggtaggtcttatttataataccataggtgtaagtgacggtatctcaatgggtactcctggtatgcggtactcactacctagtagagatattattgcagactcaatggagactgtagtacaagctatgtcttatgatgcactggttacagtggtaggttgtgataaaaatatgccgggtgctcttatggcacagcttaggctagatagaccatctatactcgtctatgggggaactatagcaccaggatttcacgaagataaaaagctagatgtagtgtctgcttttgaagcttggggagaaaaagtagctggtagtattacagagcaagagtttaaaacggtggtaaaaaaagcctgtccaggtgctggtgcgtgtggtggtatgtatactgcaaacacgatggcaagcgcgattgaggcactagggatgagcttaccctatacaagttctaaccctgcagtgtcacctaataaaactgcggagtgtgctagagtaggagctgctttaagaaacctaatagaaaaagacataaaaccctcagacattgttactcgcaagtcactagagaatgcggtgagacttgtaaccgtacttggaggatctactaatgctgtgctgcactttctcgctatagcaaaggctgcacaagtatcatttacactagaagattttcaaaaaataagcgacaccacaccttttctagcagatcttaaaccatcaggaaaataccttatggaagatttacataatgtaggaggagtgccgggcgtattaaagtatatgctagagcaaggtatgttgcacggtgactgtatgaccgtaactggtaaaactattgcagagaatctagcagttgtagaccatcttcaggcacatcaagatgttattcattcggttgagaatcctattaaagagacgggacacattcgtattctttatggaaatattgcaagtgaaggatctgtggcaaaaattacaggtaaagagggattacattttcgcggaagcgcaagagtttacaacggtgagtatgctgcaaacgcgggtataggtgcaggagaggtgaaaaagggtgatgtagtagttatacgctacgaagggccacaaggaggaccgggtatgccagaaatgctcaaacctacagcggctattatgggtgctggcttaggtaaggatgtggcacttattacagatggacgtttttctggaggtacacacggctttgttgtggggcacattactccagaggctcaagtaggtggtgggattgcgcttatagaaaatggagataccattgtgattaacgctgagactaacacaattaatgttgagataagtgagagcgaactagaagcacgtaaaaagaactgggtagctccagagcttaaagtaaaacgtggctcactttataaatatgctcgtatggtctcatctgcgagtgagggatgcgtgacagacgagttctag

SEQ ID NO: 204 - protein, 559 aa, Cellulophaga sp.
MKELNKYSKAVTQDPTQPAAQAMLHAIGLTDEDFKKPLVGIASTGYEGNPCNMHLNNLALDIKKGVQTSDLVGLIYNTIGVSDGISMGTPGMRYSLPSRDIIADSMETVVQAMSYDALVTVVGCDKNMPGALMAQLRLDRPSILVYGGTIAPGFHEDKKLDVVSAFEAWGEKVAGSITEQEFKTVVKKACPGAGACGGMYTANTMASAIEALGMSLPYTSSNPAVSPNKTAECARVGAALRNLIEKDIKPSDIVTRKSLENAVRLVTVLGGSTNAVLHFLAIAKAAQVSFTLEDFQKISDTTPFLADLKPSGKYLMEDLHNVGGVPGVLKYMLEQGMLHGDCMTVTGKTIAENLAVVDHLQAHQDVIHSVENPIKETGHIRILYGNIASEGSVAKITGKEGLHFRGSARVYNGEYAANAGIGAGEVKKGDVVVIRYEGPQGGPGMPEMLKPTAAIMGAGLGKDVALITDGRFSGGTHGFVVGHITPEAQVGGGIALIENGDTIVINAETNTINVEISESELEARKKNWVAPELKVKRGSLYKYARMVSSASEGCVTDEF

SEQ ID NO: 205 - DNA, 1680 bp, Kordia algicida
atgaacaatctcaataaatacagcaaaacagtcacacaagatcctacgcaacctgcggcacaagccatgttgcatgccattggattaacgaaagaagactttttcaaacccatcatcggaattgcaagtacaggttacgaaggaaatccgtgcaacatgcacctaaacgatctggcaaaactggcaaaacaaggaacaaaaaatgaggaggttgtcggacttattttcaatacaattggcgtaagtgatggaatctccatgggaacaccaggaatgcgttattcattgccttcacgcgatatcattgccgattctatggaaacggtagtgcaagcaatgagttatgacggattaatcacggttgttggttgtgacaaaaacatgccaggcgcactaatggcaatgattcgcctaaatcgcccaagtatcttagtctatggcggaaccattgattctggttgtcacaacggaaaaaaactcgatgttgtttctgcttttgaagcttggggaagcaaagttgcaggaactatggacgaaacagaataccaaaacattgttgaaaaagcgtgtccaggtgctggtgcttgtggcggaatgtacaccgcaaacaccatggcttctgctatagaagcattgggaatgacattaccattcaattcatcaaatcctgcgttgagcgatgctaaaaaacaagaatcggttgcggcgggcgaagcaatgcgtgttttgttagaaaaagatatcaaaccatcagacattattactcgaaaatctttggaaaatgcagttcgtttagtaacaattttgggcggatcaaccaatgcagtattacacttcttagcaattgccagagctgcacaaattgatttcacactcaaagactttcaagaaataagcgatgaaacgccgtttttggcagacttaaaacctagtggaaaatacttaatggaagacgtacacgctgtcggcggaattcctgcggtattaaaatatttactcaaaaaaggattgcttcatggcgattgtttaacggttacgggaaaaacaatggcagaaaatttattagatgtcgatgacttaacagaaggtcaagatgtcatcaaacctgtggaaaatccaataaaaatatcaggacacttacgcatgctttatggaaacctagcaagtgaaggaagcgtggcaaaaatcacaggaaaagaaggtttaaaattctctggaaaagcaaaagtatttgaaggtgaatacgaagccaatgacggaattcgtgatggaaaagtgcaaaaaggagacgtcgtcgtcattcggtatgaaggaccaaaaggcggaccaggaatgccagaaatgctaaagccaacagcagcaatcatgggtgcaggtttaggaaaagatgttgcattaattactgatggacgcttttctggaggaacacacggttttgtcgtcggacacatcacgccagaagcacaagaaggcggaacacttgctttagtaaaagatggcgatatcattaccattgatgcagaaacgaatacgatacaattagaagtttcaaacgaagaacttcaagaacgtaaaaaacaatggaaagcacccgaactcaaatttgaacgcggtgtattatacaaatatgcaaaaacagtttcatctgcatccaaaggttgcgtaactgatgaattttag

SEQ ID NO: 206 - protein, 559 aa, Kordia algicida
MNNLNKYSKTVTQDPTQPAAQAMLHAIGLTKEDFFKPIIGIASTGYEGNPCNMHLNDLAKLAKQGTKNEEVVGLIFNTIGVSDGISMGTPGMRYSLPSRDIIADSMETVVQAMSYDGLITVVGCDKNMPGALMAMIRLNRPSILVYGGTIDSGCHNGKKLDVVSAFEAWGSKVAGTMDETEYQNIVEKACPGAGACGGMYTANTMASAIEALGMTLPFNSSNPALSDAKKQESVAAGEAMRVLLEKDIKPSDIITRKSLENAVRLVTILGGSTNAVLHFLAIARAAQIDFTLKDFQEISDETPFLADLKPSGKYLMEDVHAVGGIPAVLKYLLKKGLLHGDCLTVTGKTMAENLLDVDDLTEGQDVIKPVENPIKISGHLRMLYGNLASEGSVAKITGKEGLKFSGKAKVFEGEYEANDGIRDGKVQKGDVVVIRYEGPKGGPGMPEMLKPTAAIMGAGLGKDVALITDGRFSGGTHGFVVGHITPEAQEGGTLALVKDGDIITIDAETNTIQLEVSNEELQERKKQWKAPELKFERGVLYKYAKTVSSASKGCVTDEF

SEQ ID NO: 207 - DNA, 1680 bp, Flavobacteriales bacterium
atgagtcaattaaacaaatacagtaaaactgttacacaagatccaacgcagccagctgctcaagcaatgcttcatgctattggattaactaaagaagatttttataaacctattgtaggaattgcaagtacaggttacgaaggtaacccttgtaatatgcacctcaatgacctagcgaaattggtcaaagaaggcacaaagaatgaagatgtcgtcggcttaattttcaacacaattggtgtaagtgatggcatttctatgggaacaccaggaatgcgttactcattaccttcaagagatattattgcagattctatggaaactgtagtacaagccatgagttatgatggtttagtcactgtagttggttgcgacaagaatatgcctggagccttaatggctatgataagattaaatcgtccttcgattttagtttatggaggcacaattgattctggttgtcataatgggcaaaaattagatgttgtttctgcatttgaagcttggggaagcaaagttgcaggtactatgaccgaaaatgaataccaaaatatagttgaaaaagcatgtcctggagctggtgcttgtggaggtatgtacacagcaaacacaatggcttctgctattgaggctctaggtatgacattaccttttaactcttctaatccagccttaagtgatgcaaagaaagaagagtctgtaaaagctggagaagctttaagagttttactcgaaaaagatattaagccttcagatattataactagaaaatcacttgaaaatgcagtaagattagttaccatattaggtggctctacaaatgctgtattacactttttagccattgcaagagcagctcaaattgatttcacattaaaagattttcaagatataagtgataacactccattcttagcagatttaaaaccaagtggaaaatacttaatggaagatgtacatgctgtaggaggaattcctgcggtattaaaataccttcttaaaaaaggattaattcacggagattgtttaaccgttaccggaaagacaatagctgagaatttattagatgttgctgacttaaccgaaggtcaagacgtcatcaaacccatcgaagaaccaattaaaatttctggacacttaagaatgctctacggaaacctagccactgaaggtagtgttgcgaaaattactgggaaagagggcttaagttttaaagggaaagcaaaagtatttgaaagtgaatatgatgcaaacgatggcattagagatggaaaagtagaaaaaggtgatgtcgtagtcattcgatacgaaggtccaaaaggagggcctggaatgccagaaatgctaaagccaactgctgctattatgggagctggtttaggtaaagatgtagccttgattactgatggaagattctctggaggaactcacggttttgtcgttggacacatcacacctgaagcacaagaaggcggcactcttgcttttgttgaagatggagatattattacaattgatgccgaaaccaatacgatttcagtagaagtatctgaacaagaattacaaaaaagaagaaaaaattggaaagctccagatttaaaatttgaacgtggagtactttataaatatgcaaagacagtatcatcagcttcaaaaggctgtgttactgatgaattttaa

SEQ ID NO: 208 - protein, 559 aa, Flavobacteriales bacterium
MSQLNKYSKTVTQDPTQPAAQAMLHAIGLTKEDFYKPIVGIASTGYEGNPCNMHLNDLAKLVKEGTKNEDVVGLIFNTIGVSDGISMGTPGMRYSLPSRDIIADSMETVVQAMSYDGLVTVVGCDKNMPGALMAMIRLNRPSILVYGGTIDSGCHNGQKLDVVSAFEAWGSKVAGTMTENEYQNIVEKACPGAGACGGMYTANTMASAIEALGMTLPFNSSNPALSDAKKEESVKAGEALRVLLEKDIKPSDIITRKSLENAVRLVTILGGSTNAVLHFLAIARAAQIDFTLKDFQDISDNTPFLADLKPSGKYLMEDVHAVGGIPAVLKYLLKKGLIHGDCLTVTGKTIAENLLDVADLTEGQDVIKPIEEPIKISGHLRMLYGNLATEGSVAKITGKEGLSFKGKAKVFESEYDANDGIRDGKVEKGDVVVIRYEGPKGGPGMPEMLKPTAAIMGAGLGKDVALITDGRFSGGTHGFVVGHITPEAQEGGTLAFVEDGDIITIDAETNTISVEVSEQELQKRRKNWKAPDLKFERGVLYKYAKTVSSASKGCVTDEF

SEQ ID NO: 209 - DNA, 1704 bp, Psychroflexus torquis
ttgatttttgaaaatgaaacagatacaatggaactaaataagtatagcaaaaccgttactcaagatcctactcaaccagctgctcaagctatgctgcatgctataggtctaactaaagaagatttttttaagcctatcattggtattgctagtactggatacgaagggaatccttgtaatatgcatttaaacgatctcgctaaactcgctaaacaagggacagcaaatgaagatattataggtttaatatttaataccataggggtgagtgatggaatttctatgggcacaccaggaatgcgttactctctaccttctagggatatcatcgcagactccatggaaactgttgttcaagctatgagttatgatggtttaattactgtcgtaggctgcgataaaaacatgcccggtgcattaatagcgatgattcgactcgacagaccttgcattatgatttatggaggaaccatcgattctggttgtcataatggaaaaaaattggacgtggtttccgcttttgaagcttggggaagtaaagtggctggaaccatgcaagaagaagaataccaaagcattgtagaaaaagcgtgtcctggagctggtgcttgtggagggatgtatactgctaatacgatggcctcttctatagaagctttaggaatgactttaccttataattcttccaatccagcgcttagtccagaaaaaaaacaagagtctattaaagcaggtgaagctttgagagttttattggaaaaagacatcaaaccttcagatataattacaagaaaatctttagaaaatgccatacggttaattacaattttaggaggatctacaaatgctgttttacattttttagcaattgctagagccgctgaaattgatttcactttaactgattttcaaacgattagcgataatactccttttttagcagacttaaaaccgagtggtaagtaccttatggaagatttacatgaggtaggtggaattccagcagttttgaaatatttgcttaaaaaaggccttatttatggagactgcctaaccgttacaggaaaaactttagcagaaaatttacgtgatgtagaggatcttaaagaaggtcaggaggtcatcaaaccaatagaaagccctattaaaatctcaggacatctaagaatgctctttgggaatttagctgaagagggcagtgttgctaaaattacaggaaaagaaggtttaaaatttcgaggaaaggccaaggtttttgaaggggaatacaaagctaatgacggaattagagatggaaaagttcaaaaaggagatgtagtggttatccgttatgaaggccctaaaggaggtccaggtatgccagaaatgctgaaacctactgctgcaataatgggagcagggttaggcaaagatgtcgctttgattaccgatggaagattctctggaggaactcatggttttgtagttgggcatatcactccagaagcccaagaaggcggcacgattgcccttgttgaagaaggggattatatcactattgatgccgagacaaacagtatcaatttagaagtatctgatgaggagctcatcaaaaggaaaaaaaattggaaggcaccaaatttaaaatttaaacgaggtgttctttataaatatgcgagaatggttaattctgcatcaaaagggtgcgtaacagacgaattttaa

SEQ ID NO: 210 - protein, 567 aa, Psychroflexus torquis
MIFENETDTMELNKYSKTVTQDPTQPAAQAMLHAIGLTKEDFFKPIIGIASTGYEGNPCNMHLNDLAKLAKQGTANEDIIGLIFNTIGVSDGISMGTPGMRYSLPSRDIIADSMETVVQAMSYDGLITVVGCDKNMPGALIAMIRLDRPCIMIYGGTIDSGCHNGKKLDVVSAFEAWGSKVAGTMQEEEYQSIVEKACPGAGACGGMYTANTMASSIEALGMTLPYNSSNPALSPEKKQESIKAGEALRVLLEKDIKPSDIITRKSLENAIRLITILGGSTNAVLHFLAIARAAEIDFTLTDFQTISDNTPFLADLKPSGKYLMEDLHEVGGIPAVLKYLLKKGLIYGDCLTVTGKTLAENLRDVEDLKEGQEVIKPIESPIKISGHLRMLFGNLAEEGSVAKITGKEGLKFRGKAKVFEGEYKANDGIRDGKVQKGDVVVIRYEGPKGGPGMPEMLKPTAAIMGAGLGKDVALITDGRFSGGTHGFVVGHITPEAQEGGTIALVEEGDYITIDAETNSINLEVSDEELIKRKKNWKAPNLKFKRGVLYKYARMVNSASKGCVTDEF

SEQ ID NO: 211 - DNA, 1677 bp, Flavobacteriales bacterium
atggaattgaataaatacagtaaaaacgttacccaagaccccacacaaccagctgctcaagcaatgttgtatgccataggttttaaagatgaagattttaaaaaaccattagttggtatcgcaagtacgggatatgagggcaacccttgtaacatgcatttgaatgatttggccaaattggtcaaggacggcgtgaattcaaaggaaacggttggtttgattttcaatacaattggggtgagtgatggaatatccatgggaactcctggaatgcgtttttcattaccatcaagggatattattgccgattcaatggaaacggttgtccaaggaatgtcgtatgacgccttggtaacggtggtaggctgtgataaaaatatgccgggagcattaatggccatgttaagattgaataggccatcaatattggtatacggcggtacaattgcctctggatgtcataatgatagaaaattggatattgtttctgcttttgaagcttggggagaaaaagtggctggtaccatggaggagtctgagtataaaagtataataaggaaagcgattcctggggcaggtgcttgtggtggtatgtacacggcaaataccatggcttcagccattgaagctttgggaatgtcattgccttataattcttccaaccctgcagacaattatctcaaagagaatgaatgtattgaagcaggtaagcaaatgcgcgtacttattgagaaagatattaaaccactggacattgtaactcgtaagtcattggaaaatgcgattcgtttagttactatcatgggtggctcaacaaatgcagtattacatttcttggcaattgctagagccgcagatatagaatttacactacaagattttcaacatattagtgatacaacaccttttattgcagatttaaagccaagtggcaaatatttaatggaagatgtgcaccgtgtaggtggtataccggctgtattgaaatatttattgaaaaacggacttttacatggggattgtttaacggttactggcaagacattggctgaaaatcttgaaaatgtcccagatttagaagaggggcaagatgtaattatgcctttggacaaaccaataaaagcaaccggacatttacgcatgctttatgggaatctggcagaaaatggttcagttgcaaaaattacgggaaaagaaggtttggtgtttaaaggaactgccaaagtgtttaatagcgagtatgacgccaatgatggtattcgaactggattggtgaaaaagggtgatgttgttgtaattcgatatgaagggcctaaaggaggtcctggaatgccagaaatgttgaaaccaacagcagcaattatgggagctggtttaggaaaagaagtagccttgattacagatggtcgtttttcaggaggaacacacggttttgtagtaggacatatttcacccgaagctcaagaaggtggtacaattggtttggttaaaaatggtgacataattaccattgatgctgaaactaattcaatcaatgttgctgtttctgatgaagaattggcaaaacgaaagaccgaatgggtacaaccagaattaaaattcaaaaagggcgtgctttataaatatgcgcgttcggtttcatctgctgcggaaggttgcgtaacggatgagttttaa

SEQ ID NO: 212 - protein, 558 aa, Flavobacteriales bacterium
MELNKYSKNVTQDPTQPAAQAMLYAIGFKDEDFKKPLVGIASTGYEGNPCNMHLNDLAKLVKDGVNSKETVGLIFNTIGVSDGISMGTPGMRFSLPSRDIIADSMETVVQGMSYDALVTVVGCDKNMPGALMAMLRLNRPSILVYGGTIASGCHNDRKLDIVSAFEAWGEKVAGTMEESEYKSIIRKAIPGAGACGGMYTANTMASAIEALGMSLPYNSSNPADNYLKENECIEAGKQMRVLIEKDIKPLDIVTRKSLENAIRLVTIMGGSTNAVLHFLAIARAADIEFTLQDFQHISDTTPFIADLKPSGKYLMEDVHRVGGIPAVLKYLLKNGLLHGDCLTVTGKTLAENLENVPDLEEGQDVIMPLDKPIKATGHLRMLYGNLAENGSVAKITGKEGLVFKGTAKVFNSEYDANDGIRTGLVKKGDVVVIRYEGPKGGPGMPEMLKPTAAIMGAGLGKEVALITDGRFSGGTHGFVVGHISPEAQEGGTIGLVKNGDIITIDAETNSINVAVSDEELAKRKTEWVQPELKFKKGVLYKYARSVSSAAEGCVTDEF

SEQ ID NO: 213 - DNA, 1677 bp, unknown
  unidentified eubacterium SCB49
atggaattaaataaatatagtaaacgcgttactcaagacgattcacaacctgcagcaaaagctatgcttcatgctattggtttgagtaaagaagacttagataaaccatttgttggtattgcgagtacaggttatgaagggaatccttgtaatatgcatttaaacgatttagcgcttgaagtaaaaaaaggtacaaaaaataaagatttagtaggcctaatttacaataccattggtgtgagtgatggtatttctatgggaacacctggaatgagatattccctaccctctagagatgtaattgcagattcaatggaaacggtagtagaaggaatgtcttatgatgcacttgttacggtagtaggttgtgataaaaatatgcctggagctttaatggctatgttacgtactaaccgacctggcgttttagtttatggaggcaccattgcttctggatgtcataatggtaaaaaattagatgtcgtttctgcttttgaatcttgggggcaaaaagttgctggaaaaatagatgaaaaagaatatcaagatgtcattgaaaaggcatgtcctggtgcaggtgcttgtggtggtatgtataccgcaaacacaatggcatctgctatagaggcattaggaatggcattaccatataactcttctaaccctgctttaggaacagaaaaaaaagcagaatgcataaaagctggcgaagctgtccgtttactccttgaaaaagacattaaacctaaagatattgtcacaaaaaaagcattagaaaatgccatcaggttagtaacaataatgggaggatctacaaatgccgtgttacattttttagcgattgctagaaccactgatgttgaatttacattagaggatttccaaaaaatatctgataccactccttttttagcagatttaaaacctagtggtcagtacttaatggaagatgtccatgcggttggaggaacacctgctgttttaaaatacttattaaaaaatggcttattacatggagattgtctaactgtaacaggaaaaacattggctgaaaacctccaagatgtacccgatttattagaaaatcaaaaggttataaaatcaataaacaaccctattaaagagacagggcatttaagaatattaagaggaaatttatcaccagaaggtgctgttgcaaaaattacaggaaaagagggctttaaatttacaggtaccgcaaaagtttttgattctgaatatgacgccaatgatggcattagagatggtaaagtacaaaaaggcgatgttgtagttattagatatgaaggtcctaaaggtggtcccggaatgccagaaatgctaaagcctacagcagcaattataggagctggattaggtaatgatgtagctttaattacagatggaaggttttctggtggtacgcacggttttgtagttggtcatatttcgccagaagcacaagtaggcggtcctattgcttttgtacaaaacggagatgagataactatcgacgccattaaaaataccatagactttaatatttccgaagaagttttagaaaaacgtaaagcagcctggaaacaacccgatttaaagtataaaaaaggggttttatataaatatgccagaactgtatcatgtgcatctaaaggttgcgtaacagatgaattttaa

SEQ ID NO: 214 - protein, 558 aa, unknown
  unidentified eubacterium SCB49
MELNKYSKRVTQDDSQPAAKAMLHAIGLSKEDLDKPFVGIASTGYEGNPCNMHLNDLALEVKKGTKNKDLVGLIYNTIGVSDGISMGTPGMRYSLPSRDVIADSMETVVEGMSYDALVTVVGCDKNMPGALMAMLRTNRPGVLVYGGTIASGCHNGKKLDVVSAFESWGQKVAGKIDEKEYQDVIEKACPGAGACGGMYTANTMASAIEALGMALPYNSSNPALGTEKKAECIKAGEAVRLLLEKDIKPKDIVTKKALENAIRLVTIMGGSTNAVLHFLAIARTTDVEFTLEDFQKISDTTPFLADLKPSGQYLMEDVHAVGGTPAVLKYLLKNGLLHGDCLTVTGKTLAENLQDVPDLLENQKVIKSINNPIKETGHLRILRGNLSPEGAVAKITGKEGFKFTGTAKVFDSEYDANDGIRDGKVQKGDVVVIRYEGPKGGPGMPEMLKPTAAIIGAGLGNDVALITDGRFSGGTHGFVVGHISPEAQVGGPIAFVQNGDEITIDAIKNTIDFNISEEVLEKRKAAWKQPDLKYKKGVLYKYARTVSCASKGCVTDEF

SEQ ID NO: 215 - DNA, 1689 bp, Gramella forsetii
atggataaaacagcaatgaacaacaaatatagtagtacaataacacaaagtgattctcaacctgcctcacaggcgatgcttcacgctataggattaaataaagaagatctcaaaaaaccttttgtgggaattgggagtaccggttacgaagggaatccctgtaatatgcaccttaatgaccttgctaaagaggtgaaaaaaggaactcagaatgccgatttaaacggacttattttcaatacaataggcgttagtgatgggatttccatgggaacgccgggaatgcgattctcactgccttccagagatctaatcgcagattctatggaaactgttgtaggaggaatgtcttacgatggcctggttactgtagtgggttgcgataagaatatgcccggtgccttaatggctatgttgagactgaacaggccttctgtgctggtgtatggcggaacgatcgcttccggttgccataatggtaaaaaactggatgtggtgtctgcatttgaagcctggggctcaaaagtttcaggggatatgcaggaagaagaatatcagcaggtaattgaaaaagcctgtccgggggcaggagcctgtggagggatgtatactgcaaatacaatggcctcctctatcgaagctttagggatgagtctgccgttcaacagttccaatcctgcaaccggacctgagaaaactcaggaaagtgtaaaagcaggggaggcgatgaaatatttgctggagaatgatctaaaaccaaaagatatagtgaccgcaaaatcactggagaatgcaattcgactattaacggtgcttggtggttctaccaatgccgtacttcattttcttgcgatagcaaaagctgcagagatcaattttggattaaaagattttacaagaatatgtgaggaaacgcctttcctggcagatttgaagcctagcgggaaatacctgatggaagatattcacaggattggaggaatcccggctgtgatgaaatatatgcttgaaaaaggactgcttcatggcgaatgtatgacagttaccggaaaaacgattgccgaaaatcttgaaaatgtaaagccattacctgacgatcaggatgtaattcaccctgtcgaaaaacctatcaaagctaccggacacatcagaattttatacggaaatctggcttctgaaggctccgttgccaaaataacgggaaaagaaggattggaatttcaaggaaaagcaagagtgtttaatggtgaatttgaagctaacgaagggatttcttcgggcaaggttcaaaaaggggatgtggtcgtcattcgctatgagggtcctaaaggaggacctggaatgccagaaatgctgaaaccaacttcggccattatgggcgccggactagggaaaagtgtagcccttatcaccgacggaaggttctcgggaggaactcatggctttgtggtgggacacattactcctgaggctcagcaaggcggactcattggtctgttgaaggatggtgacgagataagtattaatgccgagaaaaatactattgaggcacatctttcagcagaagaaataaatagaagaaaagaagcctggaaagctcccgctttaaaggtgaacggaggagtactctataaatacgcaaaaacggtagcatcagcttcagaaggctgcgtaacagatgaattttaa

SEQ ID NO: 216 - protein, 562 aa, Gramella forsetii
MDKTAMNNKYSSTITQSDSQPASQAMLHAIGLNKEDLKKPFVGIGSTGYEGNPCNMHLNDLAKEVKKGTQNADLNGLIFNTIGVSDGISMGTPGMRFSLPSRDLIADSMETVVGGMSYDGLVTVVGCDKNMPGALMAMLRLNRPSVLVYGGTIASGCHNGKKLDVVSAFEAWGSKVSGDMQEEEYQQVIEKACPGAGACGGMYTANTMASSIEALGMSLPFNSSNPATGPEKTQESVKAGEAMKYLLENDLKPKDIVTAKSLENAIRLLTVLGGSTNAVLHFLAIAKAAEINFGLKDFTRICEETPFLADLKPSGKYLMEDIHRIGGIPAVMKYMLEKGLLHGECMTVTGKTIAENLENVKPLPDDQDVIHPVEKPIKATGHIRILYGNLASEGSVAKITGKEGLEFQGKARVFNGEFEANEGISSGKVQKGDVVVIRYEGPKGGPGMPEMLKPTSAIMGAGLGKSVALITDGRFSGGTHGFVVGHITPEAQQGGLIGLLKDGDEISINAEKNTIEAHLSAEEINRRKEAWKAPALKVNGGVLYKYAKTVASASEGCVTDEF

SEQ ID NO: 217 - DNA, 1677 bp, Robiginitalea biformata
atgaacctgaacaaatacagtaaaaacgtcacacaggaccccacccaaccggcagcgcaggccatgctttatgccattggcctgaccgaggaggaccttgaaaaacccctgatcgggattgccagcaccgggtatgaaggcaacccgtgcaacatgcacctgaacgatctggcgctgcacgtgaaggaaggcgtgaaccgctccgatctggtagggctgattttcaatacgatcggggtgagtgacgggatatccatgggaacctacgggatgcgttattccctcccttcccgggatattattgccgattccatggagaccgtggtccaggcgatgaactacgacggcctggtaactgtagtgggctgtgacaagaacatgcccggggcgctgatggcgatgatccgcctgaaccgcccctccgtaatggtttacgggggaaccattgcatccggttgcctgaacaaccggaaactcgatgtggtatcggcttttgaggcctggggccagaaagtggccgggaatatgcaggaggaggaatacaaacaagtaatccagaacgcctgcccgggagctggtgcctgtggcgggatgtatacggccaacacgatggcatcggctatcgaagccctggggatggccctgccttacaactcttcgaacccagccaccggttcggaaaagcaggaagattgcacccgcgccggccaggcggtgcgcaccttgctcgaaaaagatatcaagccgctcgacattattacaaaaaagtccctggagaatgccatccgcctcgtagtggtgatgggggggtccacgaatgccgtcctgcacttcctggccattgccaaggcagcgcgcgtaccgtttaccctggacgatttccagcggatcagtgacgaaacgccctttttggcagacctgaagcccagcggcaaatacctgatggaagatgtccaccgggtgggcggcgtgcctgccgtccttaaattcctgctcgctgaaggcatgctccacggggattgcctgacagttactggaaaaacccttgccgagaacctaaaggatgtcccggatctggaagccggtcaggaggttatccggcccctttccgacccgatcaagaaaaccgggcacctgcgtatcctgtacgggaacctcgcacccacaggttcggttgccaaaatcaccgggaaggagggactccggttccagggacccgcccgcgtatttgaggacgaatttgaagcaaaccggggcataggcgaaggcaaagtttcccggggggatgtggtagtcatccgctacgaaggtccccagggtgggcctggtatgcccgaaatgctcaagcccaccagtgccatcatgggggccggcctgggcaaggatgtggccctgatcaccgatggccgcttttcgggtggtacccacggatttgtagtggggcatgtaacacccgaagcacaggccggaggcccgattgccctgctccgggacggggacatcatcaccatcgacgccgaagccaatacgctttcggtagacctgagcgacgaggagctcaaccggcggcgggcagcctggaaggcccctgaactaaaggtgaagcggggcagcctgtacaaatatgccaaaacggtttcatcggcctctgaaggctgtgttaccgatgaaatttga

SEQ ID NO: 218 - protein, 558 aa, Robiginitalea biformata
MNLNKYSKNVTQDPTQPAAQAMLYAIGLTEEDLEKPLIGIASTGYEGNPCNMHLNDLALHVKEGVNRSDLVGLIFNTIGVSDGISMGTYGMRYSLPSRDIIADSMETVVQAMNYDGLVTVVGCDKNMPGALMAMIRLNRPSVMVYGGTIASGCLNNRKLDVVSAFEAWGQKVAGNMQEEEYKQVIQNACPGAGACGGMYTANTMASAIEALGMALPYNSSNPATGSEKQEDCTRAGQAVRTLLEKDIKPLDIITKKSLENAIRLVVVMGGSTNAVLHFLAIAKAARVPFTLDDFQRISDETPFLADLKPSGKYLMEDVHRVGGVPAVLKFLLAEGMLHGDCLTVTGKTLAENLKDVPDLEAGQEVIRPLSDPIKKTGHLRILYGNLAPTGSVAKITGKEGLRFQGPARVFEDEFEANRGIGEGKVSRGDVVVIRYEGPQGGPGMPEMLKPTSAIMGAGLGKDVALITDGRFSGGTHGFVVGHVTPEAQAGGPIALLRDGDIITIDAEANTLSVDLSDEELNRRRAAWKAPELKVKRGSLYKYAKTVSSASEGCVTDEI

SEQ ID NO: 219 - DNA, 1677 bp, Tenacibaculum sp.
atggaattaaataaacatagcaaaagattaacccaagacgaatctcaaccagcttctcaagccatgttgtatgcagtaggtttatcagaagaagatatgagcaaagcccaagttggtattgcaagtacaggttatgatggtaatccatgtaatatgcatctaaacaatttagctgcagaagttaaagtagaaagtaaaattgctggtttagttgggttaggttttaatactattggagtttcagacggaatttctatgggaacttctggtatgaattattctttagcttccagagatataattgcagattcaatagaaactgtaatgaatgctcaaagttatgatgccttagtttctgtggtaggttgtgacaaaaatatgccaggagctgtaattgcaatgttacgtttaaataggccatcaattatgatgtatggaggtacaattgcctctggtagttataaaggtaaaaaattaaatattgtatctgcctttgaagctttaggtcaaaaagtagctggagaaatagatgagaatgaatacaaagaaattataaaaagagccattccaggagcaggtgcttgtggaggtatgtatactgcaaatacaatggcttctgcaatagaatgtatgggttttgctttgccttataattcttctattccagcagaaaatccaaataaactatctgaagcagaaagaacagctttagctattaaaaacttattagagttagatttaaaacctttagatatcatttctaaaaagtcgttagaaaatgctgttgctttagtaaatgctttgggtggatctacaaatgcagttttacactttttagctatagcacatgcagcagaaatagattttactttagaagattttcaaaaagtatcagatagaacgcctttaattgcagatttgaaaccatcaggaaaatatttaatggaagatgttcatggagttggaggtacgcctgcaattatgaaatatttattggataatgggtatttgcatggagattgcttaactgttacaggtaaaactttagcagaaaacttggcagatgttaaagcaatggagtttgaagctcaagatgttatttatccaaaagataaagctttaaaaacgtcaggaaacattcaaatcatttatggaaatctagcaacagaaggtgcagtagctaaaatttctggaaacgaaggcttgttgtttgaaggtaaagctgtggtttacgatggtgagcaagcagcaaatacaggtatttctaatggtgaagtagaaaaaggtgatgtagttgttattagatatgtggggccaaaaggtgggccaggaatgccagaaatgttaaagccaacttctttaattatgggagcaggtttaggtaaatctgtagctttaataacagatggacgtttttctggaggtacacatggttttgttgtggggcatattacaccagaagcacaatcaggaggagctattgggcttttagaaacaggtgataaaattagaattagtgcagaagacaactcaataaatgtgcttatttctgatgaagagttagagaaaagaagagcaaattgggtggctcctgctttaaaacataaaaaaggaattttatacaagtacgcaaaatctgtagcctctgcatctaaaggatgtgttactgatttataa

SEQ ID NO: 220 - protein, 558 aa, Tenacibaculum sp.
MELNKHSKRLTQDESQPASQAMLYAVGLSEEDMSKAQVGIASTGYDGNPCNMHLNNLAAEVKVESKIAGLVGLGFNTIGVSDGISMGTSGMNYSLASRDIIADSIETVMNAQSYDALVSVVGCDKNMPGAVIAMLRLNRPSIMMYGGTIASGSYKGKKLNIVSAFEALGQKVAGEIDENEYKEIIKRAIPGAGACGGMYTANTMASAIECMGFALPYNSSIPAENPNKLSEAERTALAIKNLLELDLKPLDIISKKSLENAVALVNALGGSTNAVLHFLAIAHAAEIDFTLEDFQKVSDRTPLIADLKPSGKYLMEDVHGVGGTPAIMKYLLDNGYLHGDCLTVTGKTLAENLADVKAMEFEAQDVIYPKDKALKTSGNIQIIYGNLATEGAVAKISGNEGLLFEGKAVVYDGEQAANTGISNGEVEKGDVVVIRYVGPKGGPGMPEMLKPTSLIMGAGLGKSVALITDGRFSGGTHGFVVGHITPEAQSGGAIGLLETGDKIRISAEDNSINVLISDEELEKRRANWVAPALKHKKGILYKYAKSVASASKGCVTDL

SEQ ID NO: 221 - DNA, 1677 bp, Polaribacter irgensii
atggaattaaacaaacatagcaaaagattaacacaagatgaatctcaaccggcatcacaagcaatgttgtacgctgtaggtttaacagatgaggacatgcagaaggcgcaaattggtattgcaagtactggatatgacggaaatccttgtaatatgcatttaaatcatctaaaagaagaggttaaagtagagtgtaatattgcgggtttagtcggtttagggttcaatacaattggggtgtcagatggaatttctatgggaacttcaggcatgaattattctttagtttcaagagatatcatagcagactctatcgaaacggttatgaatgcacaaagttacgatgcagtaattgctattgtgggttgtgataaaaatatgccaggatcagtgattgccatgctgcgtttaaatcgccctgcgataatgatgtatggcggctcgactgcatcgggaaattacaaaggaaaaaagttaaatattgtttccgcttttgaggctttaggtcaaaagatgtctggagaaattgaagaagaagagtatcgagaaataattaagagggccattccaggcgctggagcgtgtggtggtatgtacactgcaaatacaatggcttctgcgattgaatgtatggggttctcattgccttataattcttcaattccggcagaaaatccgaataaattgtctgaagcggaaagaactgccttggcgattaaaaacttactagaattagatttaaaacctttagatattatttctaagaaatctttagaaaatgccattacccttgtaaatgcgttaggagggtcaacaaatgccgtcttgcatttcttagcaattgcgcacgctgcagatattgagtttactttagaggattttcaaagagtgagtgacagaacaccattaattgcagatttgaaaccatcaggaaaatatcttatggaagatgtgcataatattggaggcacacctgcgatcatgaaatatttattagaaaatgactatttgcacggggattgtttgacggttacaggaaaaacattggctgagaatttagcaaatgttaaggcgatggaatttgaagagcaagatgtgatttacccaaaagagaacgcattaaaatcatcaggaaatattcaaataatttatggaaacctagcaactgaaggagcagtagcaaaaatatctggaaacgaagggctactttttgaaggaaaagctgtcgtgtatgatggtgagcaagctgcaaatacagggattacaaatggagaggtagaaagaggagatgtcgtcgttattagatacgtgggtcctcgaggaggtccaggaatgccagaaatgctgaaacctacgtccttaattatgggtgcaggtttaggaaagtctgtagcattaattacagatggaagattttctggaggaacacatggctttgttgttggacacattacaccagaagcacaatcgggaggaaccattgggattttaaaaactggcgatacaattagaattagtgcagaagataattctattaatgttttaatttctgaggatgaaattgcagcaagaaaagtaaaatgggttgcacccgcactaaagcatacaaaaggaattttgtataaatatgcaaaaacagtagcatccgcatctaaaggatgtgtaacagacttataa

SEQ ID NO: 222 - protein, 558 aa, Polaribacter irgensii
MELNKHSKRLTQDESQPASQAMLYAVGLTDEDMQKAQIGIASTGYDGNPCNMHLNHLKEEVKVECNIAGLVGLGFNTIGVSDGISMGTSGMNYSLVSRDIIADSIETVMNAQSYDAVIAIVGCDKNMPGSVIAMLRLNRPAIMMYGGSTASGNYKGKKLNIVSAFEALGQKMSGEIEEEEYREIIKRAIPGAGACGGMYTANTMASAIECMGFSLPYNSSIPAENPNKLSEAERTALAIKNLLELDLKPLDIISKKSLENAITLVNALGGSTNAVLHFLAIAHAADIEFTLEDFQRVSDRTPLIADLKPSGKYLMEDVHNIGGTPAIMKYLLENDYLHGDCLTVTGKTLAENLANVKAMEFEEQDVIYPKENALKSSGNIQIIYGNLATEGAVAKISGNEGLLFEGKAVVYDGEQAANTGITNGEVERGDVVVIRYVGPRGGPGMPEMLKPTSLIMGAGLGKSVALITDGRFSGGTHGFVVGHITPEAQSGGTIGILKTGDTIRISAEDNSINVLISEDEIAARKVKWVAPALKHTKGILYKYAKTVASASKGCVTDL

SEQ ID NO: 223 - DNA, 1698 bp, Pedobacter sp.
atgtcaacaacaccagaattaaaccgctatagcaaaacattcactcaagatcctacacaacctgccgcacaggccatgttgtatgggattggcctaacaaaagaggacctcgacaaagcccaggtaggcattgccagcatgggttacgatggaaacacctgtaacatgcacctgaacgacctcgctcaggtggtaaaaaaaggcgtctgggacaacggaatggttggcctgaccttcagcaccatcggtgtgagtgatggaatgtctaatggtacagacggaatgcgttactccctggtatccagagatgtcatcgccgattctattgagaccatctgtggcggacagtattatgatggtgtcatcaccattcctggatgtgacaaaaatatgccgggatccatcattgccatgggacgtctgaaccgcccctcgatcatggtatatggtggaagtatccactccggaaactataaaggcaaagccctgaacattgtttctgcttttgaagcattgggtcagaaacttgccggtaacatcgaagaagaagattatcaaggcatcatccgccatacctgccctggtgcgggtgcatgtggggggatgtataccgcaaatactatggcctctgcaattgaagcaatgggcatgagtttgccttatagctcctcctaccctgctaccagtcaggagaaaaaggatgaatgtatcaatgctgccaaagcaatccgtgttttgctggagagaaacattcttccaagtgacatcatgaccgagaagtcattccacaacgccatcgtaacggtgatggtactaggtggatctaccaatgccgtactccacctgattgcaatggccaaatctgtaggcctgaacctgaagatcgatgatttccaggacgtaagtaacaatactccggtacttgccgatttaaaacctagtggtacttacctgatggaagacctgcatgaaattggtggtgttcctgcagtattaaaatatctattgaaagaaggactgttgcatggcgactgtatgacggtaacgggtaaaacccttgctgagaatgtggctgatgccgtagacctggatttcgatcagcaaaagatcatcttcccggtcagcaacccgctaaaaacaactggtcacctgcagatcctgtatggcaacattgctcaaaaaggatcagtagcaaaaatcagtggtaaagaaggcgagaaatttgaaggccctgcacgtgtatttgacggggaaaaatcgttgatcgcaggaatcctgagtggacgtgtacgccagggtgatgtggtcgtgatcagacaggtaggccctaaaggagctcctggaatgcctgaaatgctgaaaccgacatctgccatcattggcgccggactgggtaaatcggttgccctgatcactgacggaaggttctccggaggtacacatggtttcgtagtgggacacatcactcctgaagcatgggatggtggaaacatcgcctttgttaatgatgatgacatgattaccattgatgcagtcaacaataccattaacctgaagatctctgatgaggaaatggctaaacgtaaggcagaatggaaacagttgcctccgccagtgaaaagcggtgtattgtacaaatacatcaagcaggttagtgatgccagcgaaggatgtgttactgacgcctacacacattaa

SEQ ID NO: 224 - protein, 565 aa, Pedobacter sp.
MSTTPELNRYSKTFTQDPTQPAAQAMLYGIGLTKEDLDKAQVGIASMGYDGNTCNMHLNDLAQVVKKGVWDNGMVGLTFSTIGVSDGMSNGTDGMRYSLVSRDVIADSIETICGGQYYDGVITIPGCDKNMPGSIIAMGRLNRPSIMVYGGSIHSGNYKGKALNIVSAFEALGQKLAGNIEEEDYQGIIRHTCPGAGACGGMYTANTMASAIEAMGMSLPYSSSYPATSQEKKDECINAAKAIRVLLERNILPSDIMTEKSFHNAIVTVMVLGGSTNAVLHLIAMAKSVGLNLKIDDFQDVSNNTPVLADLKPSGTYLMEDLHEIGGVPAVLKYLLKEGLLHGDCMTVTGKTLAENVADAVDLDFDQQKIIFPVSNPLKTTGHLQILYGNIAQKGSVAKISGKEGEKFEGPARVFDGEKSLIAGILSGRVRQGDVVVIRQVGPKGAPGMPEMLKPTSAIIGAGLGKSVALITDGRFSGGTHGFVVGHITPEAWDGGNIAFVNDDDMITIDAVNNTINLKISDEEMAKRKAEWKQLPPPVKSGVLYKYIKQVSDASEGCVTDAYTH

SEQ ID NO: 225 - DNA, 1680 bp, Flavobacteria bacterium
atggaattaaataaatatagtaaaacaataacacaagatccttctcaacctgcttctcaagcaatgttatatggaattggtttaactgaagaacaactagcaaaaccttttataggaattgcttcaatgggttatgatggaaatacttgtaatatgcatttaaatcatttagcagctttaattaaaaaagaagttaatgctaatgatatggtgggtttaattttcaacacaattggtattagtgacggtattactaacggaactgatggaatgcgttattctctagtaagtagagaaattattgcagatagtattgaaagtgttgtttcaggtcattactatgatggtgtaatttctattcctggttgtgataaaaatatgccaggaagtattattgcaatgggaagattaaatcgtccatcgataatggtttatggtggtacaattgcaccaggaaaataccaaggtaaagatttgaatattgtttcggcatttgaagcattaggagaaaaaattgcgggtactatttctgaagaagactataaaggaattataaagaattcatgtccaggtgcaggagcttgtggcggcatgtatacggcaaatacaatggctattgctattgaagcattaggaatgagcttaccttattcaagttcaaatcctgctataagtcatgataaaatagaagaatgtgaatctgccgctggatatttaaaattattattagaaaaaaatatttgtccaaaagacattatgacgtttgaagcatttgaaaatgctattaccgttttaattgctctaggaggaagtacaaatgccgttttgcatatgattgcaatggcaaaaagtgttggagtagctataagtcaggataattttcaacgattaagcaatacaactccattaattgccgattttaaaccgggtggaaattatttaatgcaaaacctacatgaaaaaggtggtgtgccaatggttttaaaatatttgctttctaaaggaatgttacatggaaattgtattacggtaacaggtaaaactttagcagaaaatttagaagcagtaatagatattgattttaacgatcaaaatattattcgtcagatagagaatccaataaaaactacagggcatcttcaaattttatatggaaatcttgctttaaaaggttccgtagcaaaaataacaggtaaagaaggcgaattttttaaaggtccagctcgtgtttttgatggtgaaaaagaattaataaaaggtatcgaagataaaaaaataaaagctggcgatgtcgtagttatacgatatgtaggtccgaaggggggacctggaatgcccgaaatgctaaagccaacatcagccttaattggtgctggtttaggaaaaagtgttgcattaattaccgatggtcgttttagtggaggaactcatggttttgtagtaggtcatatttcacctgaagcttatgatggaggtacaattgctttagttgaagatgaagatattatagaaattaatgctgttgataataccattcatttacatgttggtgatgaagaattagcgaatagaaaaagtaaatggaatcaaccaaaattaaaagtaactaatggtgtgttattaaagtatgcaaaattagttacagatgcttcaaatggttgtgtaaccgatgaatattag

SEQ ID NO: 226 - protein, 559 aa, Flavobacteria bacterium
MELNKYSKTITQDPSQPASQAMLYGIGLTEEQLAKPFIGIASMGYDGNTCNMHLNHLAALIKKEVNANDMVGLIFNTIGISDGITNGTDGMRYSLVSREIIADSIESVVSGHYYDGVISIPGCDKNMPGSIIAMGRLNRPSIMVYGGTIAPGKYQGKDLNIVSAFEALGEKIAGTISEEDYKGIIKNSCPGAGACGGMYTANTMAIAIEALGMSLPYSSSNPAISHDKIEECESAAGYLKLLLEKNICPKDIMTFEAFENAITVLIALGGSTNAVLHMIAMAKSVGVAISQDNFQRLSNTTPLIADFKPGGNYLMQNLHEKGGVPMVLKYLLSKGMLHGNCITVTGKTLAENLEAVIDIDFNDQNIIRQIENPIKTTGHLQILYGNLALKGSVAKITGKEGEFFKGPARVFDGEKELIKGIEDKKIKAGDVVVIRYVGPKGGPGMPEMLKPTSALIGAGLGKSVALITDGRFSGGTHGFVVGHISPEAYDGGTIALVEDEDIIEINAVDNTIHLHVGDEELANRKSKWNQPKLKVTNGVLLKYAKLVTDASNGCVTDEY

SEQ ID NO: 227 - DNA, 1677 bp, Flavobacterium psychrophilum
atgaacacaataaacaaatacagtaaaaccataacgcaagacgaaacccaaccagcagcacaagccatgctttatggaatagggttaacggaagcagatatgtataaagcacaagtaggaattgtaagtacaggttatgaaggtaatacttgcaatatgcacttgaacgatttagccaaagacgtaaaatttggagttgcatctgaaaatttagtcggattaatatttaatactataggcgtaagcgatggtatctctaacggtacagatggtatgcgattttcattggtatctcgagacataattgcagactctatagaaacagtggttagtgcacaatggtacgatgccgttttagccgtagtgggatgtgataaaaatatgcctggatctgtcatggctatgggaagactaaatcgacctgctataatgatatatggtggtagtattcattctggaaaatggaaaggagaatccttaaatattgtgtcggcttttgaagctttgggaaaaaaatttaacaatacaataaccccagaagattttaaaggtgttataaaaaacgcttgtccaggtgcaggtgcttgtggcggaatgtacaccgcaaacaccatggcttccgcaattgaagctttgggaatgagcttaccatatagttcgtctaatccagctttgagccaagaaaagaaacaagaatgtttagatgcaggcaaagcaatccgagttttattagaaaaagacatcaaacctaaagacatcatgaccaaaaaagccttcgaaaatgcaatgacgatggtggtggttcttggtgggtctacaaatgccgttttgcatttaatagccatggcacattcagtagatatagaattaaccctgcaagacttccaaaaaacaagtaacaacattcctgttttagcagatttaaaaccaagcggaaaatacctcatggaagatttacacgcagtgggaggggttcctgcggttatgaaatatttgctagaaaacaagctgttacacggtgattgcttaacagtaacagggaaaacagtagccgaaaatttagcaaatatccctagtttacatcaaggacaaactgtttttcttcctctaaaaacgccactaaaagccacaggacatttgcaaatcctttacggaaacctagcgccagaagggagtgttgcaaaaataagcggcaacgaaggtgatttctttgaagggaaagccaaagtttataatgatgaatataccgtgattgatggcgtaaaaaacggagaggttgcctctggagatgtagttgtaattagatattgcggaccaaaaggaggaccgggaatgccagaaatgctaaaacctacttccgcaataatgggagctggtttaggaaaaaatgtagcattaataaccgacggaagattctcggggggaactcatggttttgtagtggggcatattacacctgaagcttacgacggaggaaccattgcgctagtaaaagatggtgatacaattaccattaatactaaaaataacaccattcaattaaaagttagcgaagaagaattaaccaaaagaaaatccgaatggaaacaacctaaacttaaagctaccaaaggtgttttgtataaatatgcccaatgtgtttcaagtgcatctaaaggttgtgtaaccgataattaa

SEQ ID NO: 228 - protein, 558 aa, Flavobacterium psychrophilum
MNTINKYSKTITQDETQPAAQAMLYGIGLTEADMYKAQVGIVSTGYEGNTCNMHLNDLAKDVKFGVASENLVGLIFNTIGVSDGISNGTDGMRFSLVSRDIIADSIETVVSAQWYDAVLAVVGCDKNMPGSVMAMGRLNRPAIMIYGGSIHSGKWKGESLNIVSAFEALGKKFNNTITPEDFKGVIKNACPGAGACGGMYTANTMASAIEALGMSLPYSSSNPALSQEKKQECLDAGKAIRVLLEKDIKPKDIMTKKAFENAMTMVVVLGGSTNAVLHLIAMAHSVDIELTLQDFQKTSNNIPVLADLKPSGKYLMEDLHAVGGVPAVMKYLLENKLLHGDCLTVTGKTVAENLANIPSLHQGQTVFLPLKTPLKATGHLQILYGNLAPEGSVAKISGNEGDFFEGKAKVYNDEYTVIDGVKNGEVASGDVVVIRYCGPKGGPGMPEMLKPTSAIMGAGLGKNVALITDGRFSGGTHGFVVGHITPEAYDGGTIALVKDGDTITINTKNNTIQLKVSEEELTKRKSEWKQPKLKATKGVLYKYAQCVSSASKGCVTDN

SEQ ID NO: 229 - DNA, 1674 bp, Flavobacterium johnsoniae
atggaattaaataagtacagcaaaaccatcactcaagatcaaacacagcctgcggcgcaagcaatgttgtatggaattggtttaactgaagaagatttaaaaaaagcacaagttggtattgtcagcatgggttatgatggtaatacttgcaatatgcacttaaatgatttagcaaaagatgttaaaaaaggtgtttgggatgctggtctggtcggacttatttttaataccattggtgtaagtgacggaatttctaacggtacagaaggaatgcgttattcattagtttctcgtgatgtaatcgcagattctattgaaactgtagccggtgcacaatggtacgatagtattattgcaattcctggctgcgataaaaatatgcctggagcattaatcgcaatgggaagattaaaccgtccgtcaatgatggtttatggaggatctatccactcaggaaaatggaaaggtgaatctctaaacatcgtttctgcttttgaagctttaggaaaaaaagtaaaaggcgaaattactccggaagattttaaaggtgttattcaaaatgcttgtcctggagctggtgcctgcggtggtatgtatactgcaaacactatgtcttctgcaattgaagcattaggtatgagtatgccttacagttcttctaaccctgctttgagtcaggaaaaaagagacgaatgtattgctgccggagaagctattaaagttttattagaaaaagatattaagccaagagatattatgactcgtaaagctttcgaaaatgctattacaattgtagcagttttaggaggttctacaaacgcagttatgcacttaattgcaatggcacactctgttggtattacaattactcttgatgattttcaggcaattaacgacagaacacctgttcttgccgatatgaaaccaagtggtaaatatatgatggaagacattcacgaagtgggaggtattccgggtgtaatgaaatatttattgaaagtgggacttatccacggagattgtttaacagtaactggaaaaacagttgctgaaaacttagcttctacaccggatttacaagacggacaagaagtaattcatgaaattcaaaaagcgttaaaaccaacaggaaatattcaggttttatacggaaaccttgcttctgaaggagctgtggcaaaaatcagcggaaaagaaggggaatatttcgaaggaccagctgttgtatttgaaggggaatttgaagtaattccaggcttgcaggccggaaagattaaaccaggtaatgtcgtcgtcattagaggttgtggaccaaaaggtggtccgggaatgcctgaaatgctaaaaccgacatctgccattattggtgcaggattaggaagcagctgtgcacttattacagacggcagattctccggaggttcacacggattcgtggtaggacacgtaacaccagaggcttatgatggaggtggtattgcactagtaaaagatggagatttaattgctatcgatgctgtaaaaaatacaatcgacctgaaaatatctgacgaagaatttgcagctcgtaaagcggcttgggttcaaccagcgctaaaagttgacagaggggttttacttaaatacgcaagatcggtttctagtgcttcaacaggctgtgttaccgataattaa

SEQ ID NO: 230 - protein, 557 aa, Flavobacterium johnsoniae
MELNKYSKTITQDQTQPAAQAMLYGIGLTEEDLKKAQVGIVSMGYDGNTCNMHLNDLAKDVKKGVWDAGLVGLIFNTIGVSDGISNGTEGMRYSLVSRDVIADSIETVAGAQWYDSIIAIPGCDKNMPGALIAMGRLNRPSMMVYGGSIHSGKWKGESLNIVSAFEALGKKVKGEITPEDFKGVIQNACPGAGACGGMYTANTMSSAIEALGMSMPYSSSNPALSQEKRDECIAAGEAIKVLLEKDIKPRDIMTRKAFENAITIVAVLGGSTNAVMHLIAMAHSVGITITLDDFQAINDRTPVLADMKPSGKYMMEDIHEVGGIPGVMKYLLKVGLIHGDCLTVTGKTVAENLASTPDLQDGQEVIHEIQKALKPTGNIQVLYGNLASEGAVAKISGKEGEYFEGPAVVFEGEFEVIPGLQAGKIKPGNVVVIRGCGPKGGPGMPEMLKPTSAIIGAGLGSSCALITDGRFSGGSHGFVVGHVTPEAYDGGGIALVKDGDLIAIDAVKNTIDLKISDEEFAARKAAWVQPALKVDRGVLLKYARSVSSASTGCVTDN

SEQ ID NO: 231 - DNA, 1713 bp, Lactococcus lactis
atggaattcaaatataacggaaaagttgaatcaatagagctcaataagtattcaaaaacattgacacaagacccaacacagccagcgacccaagccatgcactatggcattggttttaaagatgaggacttcaaaaaagctcaggtcggaatcgtcagcatggattgggacggaaatccctgtaacatgcacttgggcacactcggtagtaaaatcaaaaattctgtcaatcaaactgacggactgattgggcttcaatttcacacgattggggtttctgacggaattgccaacggaaagcttggcatgagatattccttggtcagtcgtgaagttattgctgacagtattgaaaccaacgctggcgccgaatattacgatgcaattgtcgctgttcccggttgtgacaaaaatatgccaggctcaatcattggcatggctcggctcaatcgtccgtcaattatggtttatggtggaacgattgaacatggcgaatacaaaggcgaaaagttaaatattgtttcggcttttgaagcgcttggacaaaaaatcactggaaatatttccgaggaagattatcacggcgtcatttgtaatgccattccgggacagggtgcttgtgggggcatgtatacagcaaatacactggcttcggcaattgaaactttgggaatgagtttgccttattcggcttcaaatccagcggtcagtcaagaaaaagaagacgaatgtgatgaaattggtctggcaatcaaaaatttgctagaaaaagacatcaaaccaagcgatatcatgaccaaggaagcttttgaaaatgccataacgatcgtcatggttctcggtggttcaactaatgctgtgcttcatatcattgccatggctaatgccatcggtgtcgaaattacgcaagatgattttcaacgtatttccgatgtcacgcctgtgcttggcgacttcaagccaagtggcaagtacatgatggaagatttgcacaaaattggtggcgtgcctgctgttttgaaatatttgctcaaagagggcaagcttcatggcgactgtttgacagttactggtaaaactctagctgaaaatgttgaaacagcactggatttggactttgacagccaagacattattcgaccacttgaaaatcctatcaaagcaacaggtcatttgcaaattctctatggcaatcttgctgaaggtggttctgtggcaaaaatttctggaaaagaaggggaatttttcaaaggaacagctcgtgtctttgatggcgaacaacattttattgacggaattgagtcaggtcgtttgcacgcaggagatgtcgctgtcattcgtaatatcggtccagtcggaggcccaggaatgccagaaatgttaaaaccgacctcagccttgattggagcaggtcttggaaaatcttgtgctttgattactgacggacgtttctctggtggcacacatggctttgtggttggccacattgtccccgaagcggttgagggtggattgattggcttggtcgaagatgatgatattatcgagattgatgcggtcaataacagcattagtttgaaagttgctgacgatgagattgctagacgacgtgccaattatcaaaaacctgctcctaaagcaacgcgtggggttcttgctaaatttgctaaactcacgcgcccagccagtgaaggctgtgtgactgatttatag

SEQ ID NO: 232 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 233 - DNA, 1686 bp, Psychromonas ingrahamii
atgtcagaaataaataagtattcaaaaacagtgacgttagatgaatcacaaccggcttcacaggccatgctttatgctattggtttgaaagaagaggatatgaaaaaagcgcaagtgggtattgtttcaacaggatgggaaggaaatccatgcaatatgcacttaaacgaatttgctaaagacgtgaaaaaaagtgtgaacgcagctgatttggtgggattaatctttcacacaatcggagtgagtgatggtatttcaaacgggactaccgggatgaagtactctttagtgtctcgtgagatcattgctgattctattgaaacggttgtaagtgcgcaattttatgatgcgattgttgccattgtaggatgtgataaaaatatgcccggtgcaatgatggcattgtcgcgtttaaatcgtccgggaatattggtttatggcggttcggttaaagctggaaaatggaaaggtgaagacttgaatatcgtttctgctttcgaagcttatggaaaaaaattacagggtgttatctcccatgaagattataaaggggtaattcaaaatgcgatcccgggtccgggtgcttgtggtggaatgtatacggcaaatactatgtcttcagctattgaagcgttaggcatgagtttgccttactcttcatcgaacccggcggttagcgatgacaaaaaaagagaattaacaacagtgggtgatgcagttaaaaacctgctggaaaaagatattaaaccaaaagatattatgaccaaaaaagcgttcgagaatgccttaagaattattatgattttagggggctctaccaatgcaactttacatatgattgcaatggcccgatcatcaggtgttgacttgagtttagatgatttccaaaagatggcagataaaacgccattattggcaaatttaaaaccttccggggaattcctaatgcaagacttacatgaaatcggcgggatccctgcagtcatgaaatacttattggctgaaggtttattacatggggattgtttgaccgttacaggtaacaccattgctgaaaacttagctgatttacccggccttcctgatgatcaggacattatcagacctttgtctaaccccttgaaagaaactggccacttacagattctttatggaaacttggcacctgaaggttcagttgcaaagattacaggtaaagaaggcgaagtattcgaaggcccggcaagagtttatgaagatgaattttcagcaataaaaggtatcggagacgaagtgcaaaaaggtgaagttatcgttatccgttattcaggaccaaaaggtgcgcctggcatgccagaaatgctaaaaccaacttcagctgtaatgggggcgggtcttggaaaagacgtggcattaattacagatggcagattctccggaggttctcatggttttgttgttggacacgtgacgccagaggcatcggaaggtggattgattgccctggtccaaaatggagacatgatccgaattgattctgttactaacaaattggaattgaaagtcgatcaggctgaaatcaacaagcgtaaagctgcttggataaaaccagcttacagagcgacaaatggtgtactaagaaagtatatcgccacggtaaaatctgcctctctaggatgtgttaccgatgaaatagacgaactgtag

SEQ ID NO: 234 - protein, 561 aa, Psychromonas ingrahamii
MSEINKYSKTVTLDESQPASQAMLYAIGLKEEDMKKAQVGIVSTGWEGNPCNMHLNEFAKDVKKSVNAADLVGLIFHTIGVSDGISNGTTGMKYSLVSREIIADSIETVVSAQFYDAIVAIVGCDKNMPGAMMALSRLNRPGILVYGGSVKAGKWKGEDLNIVSAFEAYGKKLQGVISHEDYKGVIQNAIPGPGACGGMYTANTMSSAIEALGMSLPYSSSNPAVSDDKKRELTTVGDAVKNLLEKDIKPKDIMTKKAFENALRIIMILGGSTNATLHMIAMARSSGVDLSLDDFQKMADKTPLLANLKPSGEFLMQDLHEIGGIPAVMKYLLAEGLLHGDCLTVTGNTIAENLADLPGLPDDQDIIRPLSNPLKETGHLQILYGNLAPEGSVAKITGKEGEVFEGPARVYEDEFSAIKGIGDEVQKGEVIVIRYSGPKGAPGMPEMLKPTSAVMGAGLGKDVALITDGRFSGGSHGFVVGHVTPEASEGGLIALVQNGDMIRIDSVTNKLELKVDQAEINKRKAAWIKPAYRATNGVLRKYIATVKSASLGCVTDEIDEL

SEQ ID NO: 235 - DNA, 1677 bp, Microscilla marina
atgacagttttgaacaaatacagccgacgaattactcaggatgtaacccaaccagcctctcaagcaatgctgtatggcatagggcttactaaagaggatatgagcaagcctcaaataggcatagtaagtactggttatgagggcaatacctgcaacatgcacctcaatgatctggccttggaaaccaaaaaaggtactaaagaagcagacttggtagggttggtattccatactataggcgtaagcgacggaatatctaacggtaccgaaggaatgcgtttttcgttgccttcacgcgacattatcgccgactcgatagagactgtagtgcaggctcaatggtacgatgggatacttgctgtagtgggttgcgacaaaaacatgccgggagctatgatggctctggcgcgtttgaaccgtcctggactgcttgtttacggcggaagcatcaggtcaggctgtcacaaaggtcaaaaactcaatattgtgtctgcctttgaagcactcggacagcgttttaacggaagtttgaatgaagaagattatcaaggaattatccaaaactcttgccctggtgcaggagcttgtggcggtatgtatactgccaacacgatggcaacagtgatagaagctattggattgggcttaccttatggagcctctaatcccgcccaaagccctgaaaaacaacaagaatgtatagatgcgggcaaagctatgagaaagctgctcgaagaggacatcaaacccctcgacatattgaccaaaaaagcttttgaaaatgccttgacaatgatcatggtcatgggaggctctaccaatgcggtgctgcacatgattgccattgccaaagctgctgaggtggatctaagcctggaagattttcaacgtatcagcgacaaaactccttatttggcaaatctcaagcctagtggaaagtacttgatggaagacttgcacaccattggtggcacccctgctgtaatgaagctattgctggacgagggattgctacacggtgattgtttgacggtaacgggcaaaacgcttgctgagaatcttgctaacattgctccggtaaaagacgatcaggacgtgctgttcccaataagccaacctctaaaacctcagggacatttacaagtgttatttggcaacctggccacacaaggggcagtagctaaaattacgggcaaagagggagaaaaatttgaaggtactgccaaggtgtacgacggagagtttgaggctatcaaaggtattcaggacggagaagtaaaagctgggcacgtggtagtcattaggtacgaaggccccaagggtggtccgggaatgcctgaaatgctcaagcctacctctgcaataatgggtgccgggctgggcaatagcgtggcattgattacagatggtaggttttcgggtggttcacacggttttgtagtgggacacgtgtgccctgaagcacaggaaggtggcttgattgccttgcttaaggatggcgatcgaatcacgattgatgcggtagacaaccaaatggtggcgcacttatcagaggaagaaatagcccaacgacgcgcccaatggcaagcaccagaatcgcgctttacccgtggaattttaggcaaatatgcccgtactgtttcgtcggcctcggagggctgtgtaacggatgaatag

SEQ ID NO: 236 - protein, 558 aa, Microscilla marina
MTVLNKYSRRITQDVTQPASQAMLYGIGLTKEDMSKPQIGIVSTGYEGNTCNMHLNDLALETKKGTKEADLVGLVFHTIGVSDGISNGTEGMRFSLPSRDIIADSIETVVQAQWYDGILAVVGCDKNMPGAMMALARLNRPGLLVYGGSIRSGCHKGQKLNIVSAFEALGQRFNGSLNEEDYQGIIQNSCPGAGACGGMYTANTMATVIEAIGLGLPYGASNPAQSPEKQQECIDAGKAMRKLLEEDIKPLDILTKKAFENALTMIMVMGGSTNAVLHMIAIAKAAEVDLSLEDFQRISDKTPYLANLKPSGKYLMEDLHTIGGTPAVMKLLLDEGLLHGDCLTVTGKTLAENLANIAPVKDDQDVLFPISQPLKPQGHLQVLFGNLATQGAVAKITGKEGEKFEGTAKVYDGEFEAIKGIQDGEVKAGHVVVIRYEGPKGGPGMPEMLKPTSAIMGAGLGNSVALITDGRFSGGSHGFVVGHVCPEAQEGGLIALLKDGDRITIDAVDNQMVAHLSEEEIAQRRAQWQAPESRFTRGILGKYARTVSSASEGCVTDE

SEQ ID NO: 237 - DNA, 1689 bp, Cytophaga hutchinsonii
ttgattattgtgagtacagaattaaataaaataagtaaacgtttaacccaggatccatctcagcccgcatctcaggcaatgatgtatggagctgggtttacagacgaggatatgaaaaagccaatcgttggtattggcagtacaggtttcgatggtaacacatgtaacatgcacttaaatatccttgccggacaagttaaaggcagtattacgcgtggcggtatggttggacttggtttcaacacgatcggcgtaagtgatgggatttcaatgggtacagaagggatgcgtttctctcttgtatcacgcgacgtaattgcggattcaattgaaacaatttgtgaagctcattactacgatgcgttggtaaccgttgtaggttgtgataaaaacatgcctggcgcacttattgcaatggctcgcttgaatcgcccgtcaatcatggtatacggcggtacaattcactcaggtcactacaaaggcgaaaaactaaacatcgtttcagcttttgaagcattgggtaaaaaagtagccggcacaatcactgaagaagattaccagggtgtaattaaaaatgcatgtccgggtgcgggtgcctgtggtggcatgtacacagcaaacacaatggcatctgcaattgaagcaatgggattaacacttccttattcttcaacggcacctgcaacaagcgaaaagaaaaaggcagaaacattggcgcttggcaaagcaatgatgcatctgctggagaaagatatcaagccgcgtgatatcatgacattcgaggcatttgaaaatgctatccgtgtgatcctggtattgggtggttctacaaatgcggtaatgcacttaattgcaattgcaaaagctgcgggtgttaaattaacgatcgatgattttcaacgcatcggtaatacaacaccgttactggcagatttaaaaccaagcggcaagtatatgatggaagatatggacgctattggcggcgtaccttctgtaatgcgtttgttggcaaaacataatttacttcatttagattgtatgactgtaacaggtaaaactgttggagagaatttaaaagaagctcaggatcttcctacggatcaggatctgatgtatgcatgggaaaacccgatcaaacaaacaggtcacttacagattctgtatggcaatcttgcaccacaaggttctgtggcaaagattaccggtaaagaaggaacatactttgaaggtcctgcacgcgtgtacgactctgaagaggctgtaaacaaaggtttagaggctaatgaagtaaaatcaggtgaagtaattgtaatccgttatgttggtccgaaaggcggcccgggcatgcctgaaatgttgaagccaactgctctattaatgggcttaggtttaggcaacgaatgtgccttaatcacagacggacgtttctctggcggtacacatggtttcgtagttggccacattacaccggaagcaacagaagggggtatgattggccttgtaaaaaatggcgacatcatccgtattgatgcagtaaacagagtcctagaagttaaaatttccgaggaggaagtaaccaaacgccgtgcggcatgggtaaaacctgcgccaagagctacatccggcgtgttatataaatacatgaaattagtatcttctgcatctgagggatgcgttaccgataattaa

SEQ ID NO: 238 - protein, 562 aa, Cytophaga hutchinsonii
MIIVSTELNKISKRLTQDPSQPASQAMMYGAGFTDEDMKKPIVGIGSTGFDGNTCNMHLNILAGQVKGSITRGGMVGLGFNTIGVSDGISMGTEGMRFSLVSRDVIADSIETICEAHYYDALVTVVGCDKNMPGALIAMARLNRPSIMVYGGTIHSGHYKGEKLNIVSAFEALGKKVAGTITEEDYQGVIKNACPGAGACGGMYTANTMASAIEAMGLTLPYSSTAPATSEKKKAETLALGKAMMHLLEKDIKPRDIMTFEAFENAIRVILVLGGSTNAVMHLIAIAKAAGVKLTIDDFQRIGNTTPLLADLKPSGKYMMEDMDAIGGVPSVMRLLAKHNLLHLDCMTVTGKTVGENLKEAQDLPTDQDLMYAWENPIKQTGHLQILYGNLAPQGSVAKITGKEGTYFEGPARVYDSEEAVNKGLEANEVKSGEVIVIRYVGPKGGPGMPEMLKPTALLMGLGLGNECALITDGRFSGGTHGFVVGHITPEATEGGMIGLVKNGDIIRIDAVNRVLEVKISEEEVTKRRAAWVKPAPRATSGVLYKYMKLVSSASEGCVTDN

SEQ ID NO: 239 - DNA, 1764 bp, Rhodopirellula baltica
ttgaccctttcaaggtgttgccacccatcttcggccgctttcccctgccaaaacgatctcatgaccgcgtctcagcctgaatccgattccaatgcactgaacaagtacagcagcaagatcacccagccgaaaagccagggtgcgtcgcaggcgatgctttacgccaccggcatgtcctcggaggatatgaacaagcctcaagtcggcatcggcagcatgtggtacgagggcaacagctgcaacatgcacctgctcgatctcgcagcggatgttaaagctggagtcaccgacgccggaatggtcggaatgcgtttcaacaccatcggtgtctcggacggcatctcgatggggaccgacgggatgagcttctcactgcaaagtcgcgacctgatcgccgactcgatcgagacgatcatgggggcgcagtggtacgacgcgttgatcaccctgcccggctgcgacaagaacatgcccggctgtttgatggcgatgggacgtctgaaccgtccttccatcatggtctacggtggaacgattaaacctggcagctaccgcgacgagaagctggacatcgtcagcgcgttccagtgctacggccagttcatcgcgggacaaatcagcgaagaagaacgcagtgaaatcgttcgccgcagttgcccaggtgcgggagcatgcggcggcatgtacaccgccaacacgatggccaccgcaatcgaagccttgggcatggccctgccctactccgccagcatccctgcagagcatccagaaaagaaagaggaatgcaaacgtgccggtttggccatcctcgaactgttgaagaaggacatcaagcctcgcgacatcatgactcgcggtgcattcgaagacgcgatggtgacattgatggcactgggcggcagcaccaacgcggtgcttcacttgatcgcgatggctcgcagcgtcgatgtgccactgacgattgaagacttccaatcggtcagcgaccgcacacctttcttggccgacctgaaacccagcggcaagttcgttcaagaagacctgcacagcgtcggtggcacgcccgcggtgatgaagtacttgctcgaaaagggcatgatcaaaggcgagcacatgaccgtcaccggcaagactctcgcggagaacctggccgatttgcctggtttgaagaccggccaaaagatcgtgtcgacggtcgaagagccgatcaaaaaatcgggtcacattcgaatcctgaaaggatcactggccacggaaggcgcggtcgcgaaaatcactggcaaagaaggtctgcagttcagcggaccggctcgtgtctatgacaatgaggaattgatgctcgccgctttggaacaaaagcagattcaaaagggtgacgtcgttgtgatccgctacgaaggtcccaagggcggacccggcatgcctgagatgttgactccaaccagtgccatcatgggtgctggtttgggaagcgacgtcgcgatgctgactgacggccgtttcagcggcggtagtcacgggttcatcgtggggcacatcactcccgaagcacaagttggtggtccgatcgcattgatcgaagatggagacacgatcacgattgatgccgaaaccaactcgttggacttagaagtcgatgcggctgaattggaagcccgccgatccaagtggaccgcaccgccactgaaagccacccgcggaacgctctacaagtacatcaagtgcgtgaagagcgccagcgaaggctgcgtcaccgacgagtga

SEQ ID NO: 240 - protein, 587 aa, Rhodopirellula baltica
MTLSRCCHPSSAAFPCQNDLMTASQPESDSNALNKYSSKITQPKSQGASQAMLYATGMSSEDMNKPQVGIGSMWYEGNSCNMHLLDLAADVKAGVTDAGMVGMRFNTIGVSDGISMGTDGMSFSLQSRDLIADSIETIMGAQWYDALITLPGCDKNMPGCLMAMGRLNRPSIMVYGGTIKPGSYRDEKLDIVSAFQCYGQFIAGQISEEERSEIVRRSCPGAGACGGMYTANTMATAIEALGMALPYSASIPAEHPEKKEECKRAGLAILELLKKDIKPRDIMTRGAFEDAMVTLMALGGSTNAVLHLIAMARSVDVPLTIEDFQSVSDRTPFLADLKPSGKFVQEDLHSVGGTPAVMKYLLEKGMIKGEHMTVTGKTLAENLADLPGLKTGQKIVSTVEEPIKKSGHIRILKGSLATEGAVAKITGKEGLQFSGPARVYDNEELMLAALEQKQIQKGDVVVIRYEGPKGGPGMPEMLTPTSAIMGAGLGSDVAMLTDGRFSGGSHGFIVGHITPEAQVGGPIALIEDGDTITIDAETNSLDLEVDAAELEARRSKWTAPPLKATRGTLYKYIKCVKSASEGCVTDE

SEQ ID NO: 241 - DNA, 1683 bp, Blastopirellula marina
atgtccgccccgctcaacaagtacagcagccgcgttacccagccaaaaagccagggcgcgtcgcaggccatgctttacggaaccggcatgaccgacgccgacatggacaaagcgcaggttggcatcgccagcatttggtacgagggcaacacgtgcaacatgcacctgaatcagctctcggaagtggtgaaaaaaggggtggtaggcgccgacatggtcgggatgcggttcaacacgatcggcgtgagcgacggcatctcgatggggaccgaagggatgagcttctcgctccaatctcgcgacctgatcgccgactcgatcgaaacggtcatgggcggtcagtggtacgacggactgatcgcgctgccgggctgcgacaaaaacatgccgggatgtttgatcgcgatggggcgtttgaaccgtccgtcgatcatggtctacggcggtacgatcaaaccgggccacaccagcaagggagagaagctcgacatcgtctcggctttccagtgctacgggcaattcctctcggaaggaatcaccgaagaagaacgcaaagaaatcgtgcacaaagcttgtcctggagcgggcgcttgcggcggcatgtacaccgccaacacgatggcgacggcgatcgaagcgatgggcatgacgctgccttacagcagcagcattccggccgaagatccggcgaagcagcaagaatgcatcgacgccggcaaagcgatgcgctacttgctggagaaagatattaagccgcgcgacatcatgacccgtgatgcgtttgaaaacgcgatggtcacggtgatggcgctcggcggttcgaccaacgccgtgttgcacttgatcgcgatggctcgcgcggtggatgtcgacctgtcgatcgacgacttccaaacggtcagcgatcgcgtccctttcttggccgatctgaagccgagcggcaagtttgtgcaagaagatctgcactcgatcggcggtacgccggccgtcctgaagtatctgctggccgaaggcttcttgaagggggactgtatgacggtgaccggcaagacgctggccgaaaacatcgccgatcttcccggcttgaaagaaggccagaagatcgtccacccactgtcggacccgatcaagtcctccggtcacatccagatcttgaagggcacgctggcccccgaaggcgccgtcgccaagatcaccggcaaagaaggactccgctttcaagggccggccaatgtctttgatagcgaagaagacatgttgcacgcgctggaagacaagaagatcaaaaagggagacgtcgtcattattcgctacgaaggtcccaagggaggccccggcatgccggagatgctgactccgacctcggcgattatgggggccggtctcggcagcgatgtcgcactgctgaccgatggccgcttctccggcggctcgcacggtttcatcgttgggcatatcacgcctgaggcgcaagacggaggcccggtcgcgctcgttcaaaatggcgacatcgtcacgatcgacgccgacaccaactcgattgacgtcgacgtgccggccgatgagatggcgaaacgcttggccgcttggaaggctccggcctacaaagcgacccgcggcacgctttacaagtacatcaagaatgtgaaaagcgcttcagaaggttgcgtgaccgacgaataa

SEQ ID NO: 242 - protein, 560 aa, Blastopirellula marina
MSAPLNKYSSRVTQPKSQGASQAMLYGTGMTDADMDKAQVGIASIWYEGNTCNMHLNQLSEVVKKGVVGADMVGMRFNTIGVSDGISMGTEGMSFSLQSRDLIADSIETVMGGQWYDGLIALPGCDKNMPGCLIAMGRLNRPSIMVYGGTIKPGHTSKGEKLDIVSAFQCYGQFLSEGITEEERKEIVHKACPGAGACGGMYTANTMATAIEAMGMTLPYSSSIPAEDPAKQQECIDAGKAMRYLLEKDIKPRDIMTRDAFENAMVTVMALGGSTNAVLHLIAMARAVDVDLSIDDFQTVSDRVPFLADLKPSGKFVQEDLHSIGGTPAVLKYLLAEGFLKGDCMTVTGKTLAENIADLPGLKEGQKIVHPLSDPIKSSGHIQILKGTLAPEGAVAKITGKEGLRFQGPANVFDSEEDMLHALEDKKIKKGDVVIIRYEGPKGGPGMPEMLTPTSAIMGAGLGSDVALLTDGRFSGGSHGFIVGHITPEAQDGGPVALVQNGDIVTIDADTNSIDVDVPADEMAKRLAAWKAPAYKATRGTLYKYIKNVKSASEGCVTDE

SEQ ID NO: 243 - DNA, 1692 bp, Planctomyces maris
atgtcagccgattcgcaacccgttttgaacaagtacagttcccgtatcacacagccccgttcgcagggtgcctcgcaagccatgctctacgccaccggcatgagcgaagaggatatgaacaaggcccaggtcggaatttccagcgtctggtacgaaggcaattcctgcaacatgcacctcaacaaactggctgccaaggtcaaagagggcgtcgaagccgccgatctggttggcctgcggtttaataccatcggtgtgagcgacgggatttccatgggcaccgacggcatgtcctattcgctgcagtcccgcgacctgatcgccgacagtatcgaaacagtcacctgtgcccagtggtacgatgccaacatttcgctgcctggctgtgataagaacatgcctggctgcctgattgccatgggacgatttaaccgcccctcgatcatggtttacgggggaacgattgctcccggctgtctgaataatcagaagctggacattgtctccgcatttcagtcttacggcgaatacctggctggtacgatcacagatgaaacccgaaaagaaatcgtacagaaaagctgtccgggcgctggtgcctgcggcggcatgtataccgccaacacgatgtcgtctgccatcgaagctctggggatgtcactcccttacagttcttccattcctgcagagcatcccgataaactcgatgagtgtatccgcgctggtgccgccatcaggaaactgctggaactggatctgaaaccccgcgacatcatgacccgcgaggctttcgaaaatgcgatggtactgattgtcgcactggggggatcgaccaacgccgtgctgcacatgctggccatcgcccgttctgtcggcctggaactgactattgatgacttccagtccgtcagcgatcgtattcctttgctggccgatttcaaacccagtggtaaatacgtgatggctgacctgcaggagattggcgggacaccagccgtgatgaaatacctgctggaaaaaggcctgatcaacggcgactgcatgacggtcacgggaaaaacagtggccgaaaacctggcagaactaccgggcctcaaagagggtcaggatatcattcacgctgtcgaaaacccgatcaagccgaccggtcacctgcagatacttaaaggcaacctggctccgacaggtgccgtcgccaagatcaccggtaaggaaggcctggtcttcgaagggaccgccaacgtcttcgattccgaagaggacatgctcaaagccctcgaagacaagcagattcaaaaaggcgatgtgatcatcatccgctacgaaggccccaaagggggaccagggatgcccgaaatgctgaccccgacttccgccatcatgggagccggcctgggtaaggatgttgccctgctgaccgacggtcgtttttctggtggttcacacggctttatcgtcggacatatcactcctgaagcacaggaaggcggtccaatcgccctggtcaaaaatggcgacaaggtcattatcgacgccgacaaaaatcgactggagatggatgtcagtgatgcagagctcgaagaacgtcgcaaagcctggacggcccctccgtttaaatacacgcggggtacactttacaaatatatcaagaatgtgaaatccgcttctgaaggttgtgtgaccgacgagtaa

SEQ ID NO: 244 - protein, 563 aa, Planctomyces maris
MSADSQPVLNKYSSRITQPRSQGASQAMLYATGMSEEDMNKAQVGISSVWYEGNSCNMHLNKLAAKVKEGVEAADLVGLRFNTIGVSDGISMGTDGMSYSLQSRDLIADSIETVTCAQWYDANISLPGCDKNMPGCLIAMGRFNRPSIMVYGGTIAPGCLNNQKLDIVSAFQSYGEYLAGTITDETRKEIVQKSCPGAGACGGMYTANTMSSAIEALGMSLPYSSSIPAEHPDKLDECIRAGAAIRKLLELDLKPRDIMTREAFENAMVLIVALGGSTNAVLHMLAIARSVGLELTIDDFQSVSDRIPLLADFKPSGKYVMADLQEIGGTPAVMKYLLEKGLINGDCMTVTGKTVAENLAELPGLKEGQDIIHAVENPIKPTGHLQILKGNLAPTGAVAKITGKEGLVFEGTANVFDSEEDMLKALEDKQIQKGDVIIIRYEGPKGGPGMPEMLTPTSAIMGAGLGKDVALLTDGRFSGGSHGFIVGHITPEAQEGGPIALVKNGDKVIIDADKNRLEMDVSDAELEERRKAWTAPPFKYTRGTLYKYIKNVKSASEGCVTDE

SEQ ID NO: 245 - DNA, 1680 bp, Algoriphagus sp.
atgaccctgaaaaaacacagttgggaaatcagcgacaattcggagcatccggctgggatggctatgttgtatgccaccggaatgagcgataaaaagatgaaacagccatttgtagggatagcgagttgcggctatgaaagtaatccctgcaatatgcatttgaacgactttgccggtctgatcaaagcttcttcacaagagcaagatctgaccggtttagtttttaataccattggtatttctgacggaaccacgatgggaaccttggggatgcgttattcactggtttctagggagataattgctgattctatagagtcttttatcatagggcattcatttgatgcttgtatttctgttgcaggatgtgacaagaatatgcctggtgcattgatggggatgatccgtactaacagaccttctattttggtgtatggaggaacgatagcctctggacattataagggagaaaagctaaatatcgtttcggcatttgaagcctttggaaagcgagtgaatggaaacatttctgatgaagattatgatggtgtcatcagaaacgcatgtccaggaaaaggagcttgtggaggtatgtatactgccaataccatgtcttcagcaattgaagcgatgggaatgtcattgccttactcctcttcttatccggcaaactctccagaaaaattgagggagtgtggagaagtgaataaatatatgagaatccttttagaaaaggatttgaaacctagtgatatcatcactagaaaaagtattgaaaatgcagtaaccgtagcaattgccttaggtggtagtaccaatgcggtaatgcatatcattgcgatcgcccgaactgccggtgtagattttaccattgaggattttaaagcaatcaatgcaaaaactccaatgattggtgatttcaaaccttctggaaaattcatgatggaagaccttcacgaacaaggtggacttcctgcctttatgaagtatatgttgcagaatgggttcattcatggagattgcttaactgtgactggaaagacggttgcagaaaaccttgagaatattgaacctgtgactccatcgatggtgaatgttattcatcctttggaaacgccgataaaagcaacgggtcatttatgtgtgctttcaggaaatcttgctccagaaggagcggttgccaaaattacaggtaaagaaggaagttcttttacaggacctgcacatgtttttgactcagagcaggatgccaatgatgctatcagagatcataaaattgagaagggtgaagttattgtcattcgaaatatcggacccaaaggtggtccaggaatgcctgaaatgttgaagcctacttctatgattataggagctggtttaggatcagacgttgccttaattactgatggaagattttccggaggaacacacggatttgtggtagggcacgttacaccagaagcgtttagcggaggacctatcggattggtcagaaatggagatatcatcacgatagatgctgataacttacagctgagcgttgcgatttctgaagaggagtttgaagaaagaaagaaaacttggaaacgaaaagaaatttctgatttgcaagggactttgaaaaaatacaataaacttgttgccactgcatctgaaggttgcgtgacagataaattctaa

SEQ ID NO: 246 - protein, 559 aa, Algoriphagus sp.
MTLKKHSWEISDNSEHPAGMAMLYATGMSDKKMKQPFVGIASCGYESNPCNMHLNDFAGLIKASSQEQDLTGLVFNTIGISDGTTMGTLGMRYSLVSREIIADSIESFIIGHSFDACISVAGCDKNMPGALMGMIRTNRPSILVYGGTIASGHYKGEKLNIVSAFEAFGKRVNGNISDEDYDGVIRNACPGKGACGGMYTANTMSSAIEAMGMSLPYSSSYPANSPEKLRECGEVNKYMRILLEKDLKPSDIITRKSIENAVTVAIALGGSTNAVMHIIAIARTAGVDFTIEDFKAINAKTPMIGDFKPSGKFMMEDLHEQGGLPAFMKYMLQNGFIHGDCLTVTGKTVAENLENIEPVTPSMVNVIHPLETPIKATGHLCVLSGNLAPEGAVAKITGKEGSSFTGPAHVFDSEQDANDAIRDHKIEKGEVIVIRNIGPKGGPGMPEMLKPTSMIIGAGLGSDVALITDGRFSGGTHGFVVGHVTPEAFSGGPIGLVRNGDIITIDADNLQLSVAISEEEFEERKKTWKRKEISDLQGTLKKYNKLVATASEGCVTDKF

SEQ ID NO: 247 - DNA, 1677 bp, Candidatus Sulcia muelleri
atggcgattaatacatttagtattaaattaactaaaaatagtactttacctgctgcacaagcaatgctgtatgctactgggttaaaagaatatgattttaatcaagctcaagttggcatagttagtaattggtatgaaggtaatccatgtaatattcatttacatattattagtaataatataaaatcatctataaaaaaaaatggaatggtggggtttaaatttaatactataggtattagtgatggtatgtctatgggaacatctggaatgagatattctttaccatcaagagaattaatagctgatagtatagaaagtgttgttaaaactcaacattatgatggattaataggaattccaggatgtgataaaaatatccctggaatagttatggcaatgttacgtattaatagaccttctatattagtatatggaggtagtatatcatcaggatattataatggtaaaaaattaaatatagtttctgcttttgaagctttaggagaaaaaaatataggtaaaatttcagaattagaatataaaaatataattaaacatgcttgtcctggtccaggagcttgtggaggaatgtatacagctaatacaatggcttcttgtcttgaagcaatgggaataacaattccatattcatcttcatcattagctaatagtagctttaaaaaaaaagaatgtattaatataggttattatataaataatatattaaaaaataatattaaaccattggatattattacttataaatctataaaaaatgctataactctagcaatagcattaggaggatcaacaaatttagtaatacatattttagcaatagctaaaactgctaatttagatctaaaattagatgatattcaaaatatcaataataatgttccaattatagctaatttaaaaccaagtggagattttttaatggaagatatacaatctatgggaggaattcctataattataaaatatttattaaaagaaggatatatagaaggagactgtattactgtaacaggaaacacaataaaaaaaaatttagaaaatatacctgatctttcttttaaagaaaaaattatatatcctttattaaatcctataaaaaaaaatgggcatatacgtattttatatggtaatatagccccttatggagctgttgctaaaattactggaaaagaaggtgatattttttcaggatttgcacaagtttttaattcagaaaactctgctaataaagcaataattaataataaaattaaagaaggagatgtaatagtaattagatatgtaggtcccagaggaggtcctggaatgcctgaaatgcttaaacctacttcttacataatgggggctaatttaagtaaaaaaattgctttaataactgatgggagattttcaggaggatctcatggatttgtagtaggtcatattactccagaggctcaaaatggaggattaattgctttaatagaaaatggagatattataataattgatgcaataaagaatactataacattaaaaatatcaaaaaaagaaataaaaaatagaaaaaaaacacccttgcgagtgcgaggtaaagtaaattcaggttatttatataagtatacaaaaactgtatcatctgcttataatggatgtgtaacagataaattgtaa

SEQ ID NO: 248 - protein, 558 aa, Candidatus Sulcia muelleri
MAINTFSIKLTKNSTLPAAQAMLYATGLKEYDFNQAQVGIVSNWYEGNPCNIHLHIISNNIKSSIKKNGMVGFKFNTIGISDGMSMGTSGMRYSLPSRELIADSIESVVKTQHYDGLIGIPGCDKNIPGIVMAMLRINRPSILVYGGSISSGYYNGKKLNIVSAFEALGEKNIGKISELEYKNIIKHACPGPGACGGMYTANTMASCLEAMGITIPYSSSSLANSSFKKKECINIGYYINNILKNNIKPLDIITYKSIKNAITLAIALGGSTNLVIHILAIAKTANLDLKLDDIQNINNNVPIIANLKPSGDFLMEDIQSMGGIPIIIKYLLKEGYIEGDCITVTGNTIKKNLENIPDLSFKEKIIYPLLNPIKKNGHIRILYGNIAPYGAVAKITGKEGDIFSGFAQVFNSENSANKAIINNKIKEGDVIVIRYVGPRGGPGMPEMLKPTSYIMGANLSKKIALITDGRFSGGSHGFVVGHITPEAQNGGLIALIENGDIIIIDAIKNTITLKISKKEIKNRKKTPLRVRGKVNSGYLYKYTKTVSSAYNGCVTDKL

SEQ ID NO: 249 - DNA, 1650 bp, Candidatus Carsonella
atgaaatcaaaattaataacaaaatggccaataaaagcagcaaatagagccatgttgcgtgcagttggatataacgattatgattttaataaatttcaagttggaattgcatcaacttggagtaatataacaccttgtaataatcatatcaatgtattagctaaagcagttgaatatggagtaaattcaaaattttgtaaaggaacaatatttaatacaataacagtatctgatggaatatcaaatggtaattttggaatgaaatattcattactatcaagagatataatttcaaattcaatagaagttgttggcaaagcacaaaattttgatggtattatttctattggaggatgtgacaaaaatattcctggttgtattattggaatgtgtaatttagaaattccttcaatttttatatatggtggtacaattttaccaggcaaaaatagaacagatattgtctctgtttttgaatctttgggtaaattttataataaaactattaatgaaaaagaattgttaaatattgaaaaaaactccattattggatctggatcatgtagtggaatgtatacagcaaattcaatggcaattgttgcagaatgcctaggaattagcttaccaaactcttctattcaaaatgcgcaatcaattaataaaattgttaattgtattaattctggtaaattaataaaaatattgttagaaaataatattacaataaaaaaaattattaataaagaatctattttaaattctataaaagtaatttcattattaggtggatcaacaaattgtttaattcatttattagcaattgctaattgtttaaaaataaatttatctttaaaagatttacaatttgaaactaataacttaccaacgttatctgatttaaaaccaagtggaaaattttttatttcagatttaattaatactggtggaatacaaaaatttttaaaatatttaattgatattaatttaataaatggtaatttattaacggttacaggtaattcattaaaagaaaatttaaaatttattaaaataaattataaaaataaaatactaaaagatatcaataatcctgttaaaaaaactaatcaaatcaaaatattatttggaaacttatcaataaatggttgtatatcaaaaatatcgggtaaagaaggagaaatattctttggaaaagcactagtatttaattcagaagaagaatctgttaattatatttataaaaaaaaaattcaaaataacacaattataattataaggtatgaaggtccaaaaggaggccctggaatgagagaaatgttaactcctacttctgctttaataggagttggaaagaaaaattctgttgctttaataacagatggtagattttcaggtggaagccacggatttgttgtaggacatatttcgccagaagcatatgattttggtacaatttgtttaattaataataatgatctaataataatagatactataaacaattttattagtttatttttaaacaaaagaagcttaaaaagtagattttataaagttaaaatatttaacaaaatagtttcaggtattttaaatttatataaaaaatattcgatttgctcatcgaaaggtgcattattaaattatgaataa

SEQ ID NO: 250 - protein, 549 aa, Candidatus Carsonella
MKSKLITKWPIKAANRAMLRAVGYNDYDFNKFQVGIASTWSNITPCNNHINVLAKAVEYGVNSKFCKGTIFNTITVSDGISNGNFGMKYSLLSRDIISNSIEVVGKAQNFDGIISIGGCDKNIPGCIIGMCNLEIPSIFIYGGTILPGKNRTDIVSVFESLGKFYNKTINEKELLNIEKNSIIGSGSCSGMYTANSMAIVAECLGISLPNSSIQNAQSINKIVNCINSGKLIKILLENNITIKKIINKESILNSIKVISLLGGSTNCLIHLLAIANCLKINLSLKDLQFETNNLPTLSDLKPSGKFFISDLINTGGIQKFLKYLIDINLINGNLLTVTGNSLKENLKFIKINYKNKILKDINNPVKKTNQIKILFGNLSINGCISKISGKEGEIFFGKALVFNSEEESVNYIYKKKIQNNTIIIIRYEGPKGGPGMREMLTPTSALIGVGKKNSVALITDGRFSGGSHGFVVGHISPEAYDFGTICLINNNDLIIIDTINNFISLFLNKRSLKSRFYKVKIFNKIVSGILNLYKKYSICSSKGALLNYE

SEQ ID NO: 251 - DNA, 1674 bp, Synechococcus sp.
atgctccgctccgacgccgtcacgcagggaatctcccgctcccccaaccgcgccatgttgcgtgcggtcggttttggtgacgccgacttcggcaagccgatcatcggcatcgccaacggctacagcaccatcaccccctgcaatgtggggctgaacgatctggcgatgcgagctgaagcgtcagcgcgtcaggccggcggcatgccccaaaccttcggaaccatcaccgtcagcgatggcatttcgatgggcacggaaggaatgaagtactccctggtgagcagggaagtgatcgctgacgcgatcgaaacggcctgcaatggccagagcatggatggggtgctcgctgtcggtggctgcgacaaaaacatgcccggcgccatgctcgcgatggcccgcatgaacatcccgtccatttttgtctatggcggcaccatcaaacccggcaaactcggcggctgtgatctcaccgtggtgagtgcctttgaggccgtaggtcagatcaccagcggcaagattgacgaagaacagctaacggcgattgaaaagaatgcctgccccggtgcaggcagctgtggcggcatgttcaccgccaacaccatgagtgctgcgatcgaaaccctcggtctgagcctgccctacagctccaccatggcggcggaagactccgagaaggctgatagcgcagcccgttcagccgaggtgcttgttgatgccatcaaagccaacattcgcccgcttgatctactcaccaaggaagcgtttgaaaacgccatcagcgtgattatggccgtgggtggctccaccaattcagtgctccacctgctcgccattgcccgcactgccggcgtcgatctgagcatcgacgattttgagcgcatccgtcagcgggtcccggtgatctgtgacctcaaacccagtggccgttttgtcacggttgatcttcatcaggctgggggcattcctcaggtgatgaaattgcttctggatggaggactactccatggcgagtgccgcaccatcgaaggcaaaagcctgaaggaactgttggctgatgtgccttcggttccgcctgctgatcaggaggtcattcgcccactgtccaatcccttgtacgccaaggggcacctggccatcctcaaaggcaacctcgcctcagaaggtgccgtcgcaaagatcagcggtgtgaaaaatccggtgatcaccggtccggcacgggtgttcgaaagcgaagaaacctgccttgccgccatcctcgacaaccaggtcaaggccggtgatgtggtggtcgttcgcaacgaaggcccggtgggtggtcccggcatgcgggaaatgctcagccccacatccgcaattgtgggacagggcctgctcgacaaagtggccctgattaccgacggacgtttctccggtggttcctacggcttggtgatcggccacgtggcgccagaagccgccgtcggtggcaccatcggcctagtgcatgaaggcgacagcatcactgtcgacgccaacaaactgctgattcaactgaacatcgacgaagccgaactggaacgccgccgtaacgcctgggcgcctgcgaccccgaagtaccgcacagggatcctgggcaaatatgcgcgcctggtctcaagttccagccgcggcgccaccaccgacatcgcggactaa

SEQ ID NO: 252 - protein, 557 aa, Synechococcus sp.
MLRSDAVTQGISRSPNRAMLRAVGFGDADFGKPIIGIANGYSTITPCNVGLNDLAMRAEASARQAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETLGLSLPYSSTMAAEDSEKADSAARSAEVLVDAIKANIRPLDLLTKEAFENAISVIMAVGGSTNSVLHLLAIARTAGVDLSIDDFERIRQRVPVICDLKPSGRFVTVDLHQAGGIPQVMKLLLDGGLLHGECRTIEGKSLKELLADVPSVPPADQEVIRPLSNPLYAKGHLAILKGNLASEGAVAKISGVKNPVITGPARVFESEETCLAAILDNQVKAGDVVVVRNEGPVGGPGMREMLSPTSAIVGQGLLDKVALITDGRFSGGSYGLVIGHVAPEAAVGGTIGLVHEGDSITVDANKLLIQLNIDEAELERRRNAWAPATPKYRTGILGKYARLVSSSSRGATTDIAD

SEQ ID NO: 253 - DNA, 1671 bp, Synechococcus sp.
atgctccgctccgatgccgttaccaaggggattcagcgctcacccaatcgggcgatgctgcgagccgtcggtttcggcgatcaggacttcggaaaaccaatcattggcatcgccaacggctacagcacgatcacgccctgcaacgttgggctcgatgatctcgccaggcgtgccgaagaggcggcccgcctagcgggaggtatgcctcaaacgttcgggaccatcaccgtcagcgacgggatctcgatgggaacagagggaatgaaatattccctggtgagccgggaagtgatcgccgacgccatcgaaacagcctgcaatggccagagcatggacggcgtgttggccgtgggcggctgcgacaagaacatgcctggagccatgctcgcgatggcgaggatgaacatcccggcgatcttcgtgtacggcggcaccatcaagcccggaaaactcggcggctgcgacctcaccgtggtcagtgcttttgaagcggtcggtcagatcaccagcggcaagatcgacgaggagcagctcacggccatcgagaaaaatgcctgccccggggctggcagctgcggcggcatgttcaccgccaacaccatgagcgccgccatcgaaacgatgggactcagccttccgcacagctccaccatggctgctgaagatgaagagaaggccgagagcgcagcccgatcggcggaggtgttggtgcaggccatcgaatccggcatccgccccctcgacctgatgacccgtgaggccttcgaaaatgccatcagcgtgatcatggcggtgggtggttccaccaattccgtgctgcatttgctcgccattgcccgcactgctggggtggagctcgccatcgacgactttgaacggatccgccagcgcgttccagtgatctgcgacctcaaacccagtggccgttacgtcacggtggacctccaccgcgccggtggaattccccaggtgatgaaactgctgctggatgccggactcctccacggtgattgccgcaccatcgaaggcaaaaccctgaaggagctgcttgccgatgtgccctccactccgcccgcggatcaggatgtgattcggccgctctccaatcccctttatgccaagggccacctggccatccttaagggcaatctggcttccgaaggagctgtcgcgaagatcagtggtgtgaagaatccggtgatcaccggtccagcaagggtgtttgagagcgaagaaagctgtcttgaagcgattctcgacaatcagatcaaggccggtgatgtggtggtggtgcgcaatgaaggcccggtcggcggaccgggcatgcgcgagatgctcagtcccacgtccgcgatcgtgggacaagggctactcgacaaggtggcgctgatcaccgacggacgcttttcaggtggctcctatggcctcgtgattggccatgtagcccccgaagcggccgtgggcggaaccatcggtttgatcgaggaaggagacagcatcaccgtggacgccaatcagctgctgctgcaactgaatgtggaggaggctgagctggagcggaggcggagtgcatggtcggcaccagtgccgaagtaccgcacggggatcctcggcaaatatgcccggcttgtgagttccagcagccagggtgcggtcaccgaccagccctga

SEQ ID NO: 254 - protein, 556 aa, Synechococcus sp.
MLRSDAVTKGIQRSPNRAMLRAVGFGDQDFGKPIIGIANGYSTITPCNVGLDDLARRAEEAARLAGGMPQTFGTITVSDGISMGTEGMKYSLVSREVIADAIETACNGQSMDGVLAVGGCDKNMPGAMLAMARMNIPAIFVYGGTIKPGKLGGCDLTVVSAFEAVGQITSGKIDEEQLTAIEKNACPGAGSCGGMFTANTMSAAIETMGLSLPHSSTMAAEDEEKAESAARSAEVLVQAIESGIRPLDLMTREAFENAISVIMAVGGSTNSVLHLLAIARTAGVELAIDDFERIRQRVPVICDLKPSGRYVTVDLHRAGGIPQVMKLLLDAGLLHGDCRTIEGKTLKELLADVPSTPPADQDVIRPLSNPLYAKGHLAILKGNLASEGAVAKISGVKNPVITGPARVFESEESCLEAILDNQIKAGDVVVVRNEGPVGGPGMREMLSPTSAIVGQGLLDKVALITDGRFSGGSYGLVIGHVAPEAAVGGTIGLIEEGDSITVDANQLLLQLNVEEAELERRRSAWSAPVPKYRTGILGKYARLVSSSSQGAVTDQP

SEQ ID NO: 255 - DNA, 1674 bp, Synechococcus sp.
atgcttcgctcagacgccgtcactcaaggcattcagcgctcacccaatcgagcaatgctgagagcggttggcttcggtgatgaagatttcggcaagcccattatcgggatcgctaacggttacagcacgattacaccttgcaatgtgggattgaatggtctgtcccgtcgtgccgaagattcggctcgaaaggcaggtggaatgcctcagactttcggaaccatcaccgtcagcgatggcatctcgatgggcacggaaggaatgaaatattccttggtgagccgtgaagtgattgctgatgcaattgaaacggcctgcaatgggcaaagtatggatggcgttctggcggttggtggttgcgataaaaatatgcctggcgccatgttggcgatggcacgtatgaatatcccctcgatttttgtgtacgggggaacaattaagccgggaaaattaggtggctgtgacctcactgttgtgagtgcttttgaggctgtcggtcagattacgagtgggaaaattgatgaagagcagctaactgcgattgaaaaaaatgcctgcccaggtgctggcagctgtggaggcatgttcacggccaatacgatgagtgctgcgattgaaacgatggggctgagtcttccccacagttcaacgatggctgccgaagatgaggaaaaagcagagagtgcggctcgttctggtgaagtcctcgttgaggcaattaaatccaatattcgcccccttgatttgctcacgcgggaagcctttgaaaatgccatcagcgtgatcatggcggtgggcggctccaccaactctgtgttgcatttgcttgctatcgcgcgcacagcaggcgtggatctcagcatcgacgactttgaacagatccgccaacgcgttccggtgatttgtgatctaaaaccgagtggtcgttttgtcaccgtggatcttcatcaggctgggggcattccacaggtgatgaaattgcttttagatgcgggcttgctccatggcgattgccgcacgattgaagggaaaacattgaaagaattgttggctgatattccttcaacgcctcctgaaggacaagaagtgattaggccgttaagtaaccccctttatgccaaagggcatttggccattctgaaaggaaatttggcaagcgaaggagctgtcgccaaaatcagcggcatcaaaacgcctgtcctcacaggtcctgctcgcgtttttgaaagcgaagaggattgtttagcgtcgattattggtaaacatattcatgctggtgatgtcatcgtgattcgccaggaaggtccagtgggaggtcctggaatgcgcgaaatgcttgcaccaactgctgccattgttgggcagggactcggtgacaaggtggcgctgattacggatggtcgattcagtggtggaacctatggtttggtggttggccacgtggctccagaagctgccgttggtggagcaatcggccttgttatggaaggagacagcatcactgtggatgccaatcaaaaccttcttcaactcaatgtgaatgaggctgaactcgaaacacgccgccgcacttggtcaggacataagcctagatacaagactggaattcttggcaaatatgctcgacttgtctcgagttctagtcgtggtgccgtgacagatcagcctgattaa

SEQ ID NO: 256 - protein, 557 aa, Synechococcus sp.
MLRSDAVTQGIQRSPNRAMLRAVGFGDEDFGKPIIGIANGYSTITPCNVGLNGLSRRAEDSARKAGGMPQTFGTITVSDGISMGTEGMKYSLVSREVIADAIETACNGQSMDGVLAVGGCDKNMPGAMLAMARMNIPSIFVYGGTIKPGKLGGCDLTVVSAFEAVGQITSGKIDEEQLTAIEKNACPGAGSCGGMFTANTMSAAIETMGLSLPHSSTMAAEDEEKAESAARSGEVLVEAIKSNIRPLDLLTREAFENAISVIMAVGGSTNSVLHLLAIARTAGVDLSIDDFEQIRQRVPVICDLKPSGRFVTVDLHQAGGIPQVMKLLLDAGLLHGDCRTIEGKTLKELLADIPSTPPEGQEVIRPLSNPLYAKGHLAILKGNLASEGAVAKISGIKTPVLTGPARVFESEEDCLASIIGKHIHAGDVIVIRQEGPVGGPGMREMLAPTAAIVGQGLGDKVALITDGRFSGGTYGLVVGHVAPEAAVGGAIGLVMEGDSITVDANQNLLQLNVNEAELETRRRTWSGHKPRYKTGILGKYARLVSSSSRGAVTDQPD

SEQ ID NO: 257 - DNA, 1674 bp, Synechococcus sp.
atgcttcgctccgacgccgtcaccaaggggatccagcggtctcccaaccgcgccatgttgcgggccgtgggctttggagacagtgatttcggcaagcccatcctgggcattgccaacggctacagcactatcaccccctgcaatatcgggctgaacgacctggccaaacgggctgaggaagcagcccgccaggccggaggcatgccccagatgtttggaaccatcaccgtgagtgatggaatctccatgggcactgaagggatgaagtactccctggtgagccgtgaagtgattgctgacgccatcgaaacggcctgcaacggtcagagcatggatggggtgctggccgttggtggctgcgacaagaacatgcctggcgccatgctggccatggctcggatgaacattccttcggttttcgtctacggcggcacgatcaagccgggcaagctcgggggctgtgatctcacggtggtgagcgcttttgaggcggtggggcaactcaccagcggcaagatcgacgaagtgcagctcaccgcagttgagaaaaatgcctgccctggggctggcagttgcggcggcatgttcaccgccaacaccatgagtgccgccatcgaaacgatggggctgagccttccctacagctccacgatggcagccgaggacgaggaaaaggccgacagtgccgctcgctccgctgaggtgctggtggaggcagtgaaagccaacattcgccctctggacctgctcaccaaggaagcctttgagaacgccattagcgtgatcatggcggtgggtggctccaccaatgcggtactgcacctgctggccattgcccgtaccgccggcgtcgacctgagcatcgatgacttcgaacggatccgtcagcgggtgccggtgatctgtgatctcaagcccagcggccgctacgtgaccgttgatctgcacaacgccggcggcattccccaggtgatgaagctgctgctggatgctggcttgctgcacagcgactgccgaaccgtggaaggcaaaagcctgaaggagttgctggccgatgtgccgtcggagccccccgccgggcaggaggtgatccgccccctcagcaatccgctgtacgccaaaggtcacctcgccatccttaagggcaacctcgccagcgagggaagcgtggccaagatcagcggcgtgaaaacccctgtgctcactggccctgcgcgggtgtttgaaagcgaggaagactgccttgccgccatcctcgataaaaagatccaggccggggatgtggtggtggtccgcaacgagggtcccgttggtggaccgggcatgcgggaaatgctggctccaacttcagcgattgttggtcagggcctgggggacaaggtcgccctgatcaccgatggccgctttagcggcggcacctatggcctggtggtgggtcatgtggctcctgaagctgctgttggtggaacgatcggcctggtgcaagaaggcgacagcatcacggttgatgctgatcagctgctgctccaactcaacgtggatcaagcggaactggatcgccgtcgtgcgggatggagcaagccggaaccgcgttaccgcagcggaattctcggcaagtacgcgcggctcgtctccagctcaagccggggtgcaaccaccgaccacgccgactga

SEQ ID NO: 258 - protein, 557 aa, Synechococcus sp.
MLRSDAVTKGIQRSPNRAMLRAVGFGDSDFGKPILGIANGYSTITPCNIGLNDLAKRAEEAARQAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQLTSGKIDEVQLTAVEKNACPGAGSCGGMFTANTMSAAIETMGLSLPYSSTMAAEDEEKADSAARSAEVLVEAVKANIRPLDLLTKEAFENAISVIMAVGGSTNAVLHLLAIARTAGVDLSIDDFERIRQRVPVICDLKPSGRYVTVDLHNAGGIPQVMKLLLDAGLLHSDCRTVEGKSLKELLADVPSEPPAGQEVIRPLSNPLYAKGHLAILKGNLASEGSVAKISGVKTPVLTGPARVFESEEDCLAAILDKKIQAGDVVVVRNEGPVGGPGMREMLAPTSAIVGQGLGDKVALITDGRFSGGTYGLVVGHVAPEAAVGGTIGLVQEGDSITVDADQLLLQLNVDQAELDRRRAGWSKPEPRYRSGILGKYARLVSSSSRGATTDHAD

SEQ ID NO: 259 - DNA, 1674 bp, Synechococcus sp.
atgcttcgttccgacgccgtcacaaaggggatccagcgttcccccaaccgcgccatgctccgtgcggtgggattcggagatgaggacttcggcaagccgattctcgggatcgccaacggctacagcacgatcacaccctgcaatgtcgggttgaacgacctgtcccggcgcgctgaagaggctgcccgtcaggccggcggcatgccacagatgttcggaaccatcacggtgagtgatggcatctccatgggcaccgaagggatgaagtactccctggtaagccgtgaggtgatcgccgatgcgattgaaaccgcctgcaatggccagagcatggatggcgtgctggcggtgggcggctgcgacaagaacatgcccggcgccatgttggccatggcgcggatgaacattccggctgtgttcgtttacggcggcacgatcaagccggggaaactcggcggctgtgatctcaccgtggtcagcgcctttgaggcagttggtcagctcaccagcggcaacatcgacgaagaccagctcaccgctgtcgaaaagaacgcttgcccaggagccggcagctgcggcggcatgttcaccgccaacacgatgagtgcagccatcgaaacgatggggttgagcctgccctacagctcaacgatggcggcagaagacgaagagaaggccgacaatgccgctcgttcagcagaggtgttgttggacgcggtgaaggccaacattcgacccttggatctgctcaccaacgatgcattcgagaacgccatcagcgtgatcatggcggtgggtggatccaccaacgccgtgctgcacctgctggcgatcgcccgtacggctggggtctccctcagcatcgacgacttcgagcggatccgtcagcgcgtgccggtgatctgtgacctcaagccgagcggccgctacgtgacggtggatctccacaacgctggcggtatcccccaggtgatgagactgctgctcgatgccgggctgctgcatggcgattgccgcaccgttgagggcaaaagcctgcgtgaggtgctggcggatgtgccctccgtgccaccggccgatcaagacgtgatccgtccactgagcaatcccctttacggcaaaggccacctggccatcctcaagggcaacctggccagtgagggcagtgtggccaagatcagcggcgtcaagacaccagtgctcaccggccccgcccgggtatttgagagcgaggaagactgcctcgccgccatcctggatcaacggatcaaggccggcgatgtggtggtggtgcgcaatgaggggcccgtgggaggtccgggcatgcgcgaaatgctggcccctacctccgccatcgtcgggcaaggcctgggagacagggtggctctgatcaccgatggccgcttcagcggcggcacctatggcctggtggtcggtcacgttgcccccgaagccgctgtcggcggaaccatcggcctggtgcagggaggcgacagcatcaccgtggatgccgaccagttgctgctgcaactcaacgtggatgaggcggaactcacgcgacgccgggcagcctggagcaagccggaaccccgttatcgcactgggattctgggcaagtacgcccgtctggtgtccagttcaagccgtggagcggtcaccgaccagcccgactga

SEQ ID NO: 260 - protein, 557 aa, Synechococcus sp.
MLRSDAVTKGIQRSPNRAMLRAVGFGDEDFGKPILGIANGYSTITPCNVGLNDLSRRAEEAARQAGGMPQMFGTITVSDGISMGTEGMKYSLVSREVIADAIETACNGQSMDGVLAVGGCDKNMPGAMLAMARMNIPAVFVYGGTIKPGKLGGCDLTVVSAFEAVGQLTSGNIDEDQLTAVEKNACPGAGSCGGMFTANTMSAAIETMGLSLPYSSTMAAEDEEKADNAARSAEVLLDAVKANIRPLDLLTNDAFENAISVIMAVGGSTNAVLHLLAIARTAGVSLSIDDFERIRQRVPVICDLKPSGRYVTVDLHNAGGIPQVMRLLLDAGLLHGDCRTVEGKSLREVLADVPSVPPADQDVIRPLSNPLYGKGHLAILKGNLASEGSVAKISGVKTPVLTGPARVFESEEDCLAAILDQRIKAGDVVVVRNEGPVGGPGMREMLAPTSAIVGQGLGDRVALITDGRFSGGTYGLVVGHVAPEAAVGGTIGLVQGGDSITVDADQLLLQLNVDEAELTRRRAAWSKPEPRYRTGILGKYARLVSSSSRGAVTDQPD

SEQ ID NO: 261 - DNA, 1674 bp, Synechococcus sp.
atgctcagatccgacgccgttaccaaagggattcagcgatcccccaaccgcgccatgctccgggccgttggttttggtgatgctgatttcggcaaaccgatcctgggaatcgccaacggctacagcacgattacgccctgcaatatcgggcttgatgttttagcgaaacgtgccgaagaagcggcccgtctggctggaggaatgccgcaaatgtttggcaccatcacggtgagtgatggaatctcgatggggactgaagggatgaaatattcccttgtcagccgagaagtcatcgccgatgccatcgaaacggcctgtaacggtcagagcatggatggagtcttggcagttggtggctgcgacaaaaatatgcctggtgcgatgttggccatggcacggatgaatatcccctccgtgtttgtttatgggggaacgatcaagccgggaaaactcggcggctgtgatctcactgtggtgagtgcctttgaagccgttggtcaaatcaccagcggcaaaatcgatgaagaacaactcacggcggtggaaaagaacgcctgtcctggtgcaggaagttgcggcggcatgtttaccgccaacacgatgagtgcagccatcgaaacgatggggttaagccttccttacagctccacgatggcggccgaagaccaggaaaaagcggacagcgcggctcgctcagcagaggtgttggtggatgccgtgaaagccaacatccggccgctcgatctgctcacaaaacaagccttcgaaaacgccatcagcgtgatcatggcggtcggcggttccaccaatgccgttttgcatttgctggcgattgctcgcacagctggggttgatttgagcattgacgactttgaacgcattcggcaacgcgtcccagtgatctgcgatctcaaacccagcggtcggtttgtcaccgttgatctgcacaacgctggaggaatccctcaagtgatgaagttgctgcttgatgccggattgctccacggcgattgccaaacagttgaagggaaaagtctcaacgcattgttggcggatgtgccatctgcaccccccgcagaccaagaggtgattcgacctctgagcaatccgatgtacagcaaaggacaccttgccatcctcaaaggaaatttggccctggagggcagtgtggccaagatcagcggcgtcaaaactcctgtactgacgggtccagctcgggtttttgaaagtgaggaagactgtctggcctccatccttgagaaaaggatcaatgcgggagacgtcgttgtgatccgctacgaaggtccggtcggtggacctggcatgcgggaaatgttggcgcccacctcagccatcgtcggccagggactcggcgacaaagtggcattaattaccgatggacgatttagcggtggtacctacggactcgtggtgggtcacgtcgctccagaagccgctgttggtggaacgattggccttgtgcaagagggagacagcatcaccgtggatgccaatcaactcttgcttcagctcaatgttgacgacacggaattagccaaacgacgagcagcatggtcgaaaccaaaacctcaatacaccactggaattttgggtaaatatgcccgactcgtttccacatccagcaaaggggctgtcaccgatcaaccggattaa

SEQ ID NO: 262 - protein, 557 aa, Synechococcus sp.
MLRSDAVTKGIQRSPNRAMLRAVGFGDADFGKPILGIANGYSTITPCNIGLDVLAKRAEEAARLAGGMPQMFGTITVSDGISMGTEGMKYSLVSREVIADAIETACNGQSMDGVLAVGGCDKNMPGAMLAMARMNIPSVFVYGGTIKPGKLGGCDLTVVSAFEAVGQITSGKIDEEQLTAVEKNACPGAGSCGGMFTANTMSAAIETMGLSLPYSSTMAAEDQEKADSAARSAEVLVDAVKANIRPLDLLTKQAFENAISVIMAVGGSTNAVLHLLAIARTAGVDLSIDDFERIRQRVPVICDLKPSGRFVTVDLHNAGGIPQVMKLLLDAGLLHGDCQTVEGKSLNALLADVPSAPPADQEVIRPLSNPMYSKGHLAILKGNLALEGSVAKISGVKTPVLTGPARVFESEEDCLASILEKRINAGDVVVIRYEGPVGGPGMREMLAPTSAIVGQGLGDKVALITDGRFSGGTYGLVVGHVAPEAAVGGTIGLVQEGDSITVDANQLLLQLNVDDTELAKRRAAWSKPKPQYTTGILGKYARLVSTSSKGAVTDQPD

SEQ ID NO: 263 - DNA, 1677 bp, Synechococcus sp.
atggcccccctccgatccagcgccatcacgcaaggtgttcagcgcagtcccaaccgcgccatgttgcgcgctgttggtttcggagatggtgacttcagcaaaccgatcatcgggattgccaacggttacagcaccatcacgccctgcaatgtggggctcaacgatctagccctgcgcgccgaagcagccacacaagcagccggggggatgccgcaactcttcggcaccatcaccgtgagtgatggcatctccatgggcaccgaggggatgaagtactccctggtgagccgcgaagtgattgccgatgccatcgagaccgcctgcaacggtcaaagcatggatggcgtattggccatcggcggctgcgacaaaaacatgcccgccgccatgttggcgatggcgcggatgaacatcccaggtgtcttcgtctatggcggcaccatcaagcccggcaaattgggcggctgcgacctcaccgtggtcagcgcctttgaagcggttggtcagttgagcagcggcaagatcgatgaagcccagctcaccgctgttgaaaagaacgcttgcccaggagctggcagctgtggtggcatgttcacggccaacacgatgagtgcggccatcgaaacgatggggttgagcttgccgttcagctccaccatggcggcggaagatcccgagaaagccgagagcgctgctcgctcggctgaggtgttggtggaggccattgctgccaacattcgtccgttggatctgctgacccgcgaagcgtttgaaaacgccatcagcgtgatcatggccgtgggtggctccaccaatgcggtgttgcacttgctcgcgattgcacgcaccgccggcgtaccactgtcaatcgacgacttcgaaacgattcggcaacgggtgcctgtgatctgcgatctcaaaccaagcggacgctttgtaacggtcgacctgcacaacgctggtggcattccgcaagtcatgaaacttctgctcgatggtgggttgctccatggcgattgccgcaccgtggagggcaaaaccttgcgagaggttctggctgatgttccctcagaaccgccggctgatcaggaggtgatccggcccctgagcaatcccctctatgccaaagggcacctggctgtgttgaaaggcaacctcgccagtgaaggggctgtcgccaagatcagtggtgtcaaaacaccagtgctcacaggcccagccagggtgtttgaaagcgaagagcagtgcctgcaggcgatcttggcgaaccaggttcacgcaggtgatgtggtggtggtgcgcaatgaaggccccgttggtggcccgggaatgcgggagatgttggcgcccaccgccgccatcgttggtgaagggctcggcgacaaggtggcgttgatcaccgacggtcgcttcagcggcggcacctacggcctggtggttgggcatgtggccccagaagcagccgtaggcggcatgatcggcctggtgcaagagggcgattccatcaccgtggatgcccaacaacaattgctgcagctcaatgtggatgccgctgaattggagcggcgcaagcaagcgtgggtcaaaccagaaccgcgttaccgcaccggtgttttgggtaaatacgcccgtttggtgagcagcagcagcaagggcgctgtgactgatcaaccctga

SEQ ID NO: 264 - protein, 558 aa, Synechococcus sp.
MAPLRSSAITQGVQRSPNRAMLRAVGFGDGDFSKPIIGIANGYSTITPCNVGLNDLALRAEAATQAAGGMPQLFGTITVSDGISMGTEGMKYSLVSREVIADAIETACNGQSMDGVLAIGGCDKNMPAAMLAMARMNIPGVFVYGGTIKPGKLGGCDLTVVSAFEAVGQLSSGKIDEAQLTAVEKNACPGAGSCGGMFTANTMSAAIETMGLSLPFSSTMAAEDPEKAESAARSAEVLVEAIAANIRPLDLLTREAFENAISVIMAVGGSTNAVLHLLAIARTAGVPLSIDDFETIRQRVPVICDLKPSGRFVTVDLHNAGGIPQVMKLLLDGGLLHGDCRTVEGKTLREVLADVPSEPPADQEVIRPLSNPLYAKGHLAVLKGNLASEGAVAKISGVKTPVLTGPARVFESEEQCLQAILANQVHAGDVVVVRNEGPVGGPGMREMLAPTAAIVGEGLGDKVALITDGRFSGGTYGLVVGHVAPEAAVGGMIGLVQEGDSITVDAQQQLLQLNVDAAELERRKQAWVKPEPRYRTGVLGKYARLVSSSSKGAVTDQP

SEQ ID NO: 265 - DNA, 1671 bp, Synechococcus sp.
atgctccgctccgccgcgatcacccaggggattcagcgctctccgaatcgagccatgctccgtgctgtgggtttcggcgacggcgacttcaacaagccgatcatcggcatcgccaacggctacagcaccatcaccccctgcaatctggggctcaatgatcttgctcgacgcgccgaggaagccgcccatcaggtgggagcgatgccccagatgttcggcaccatcaccgtgagcgatgggatttcgatggggaccgaagggatgaaatattcccttgtgagccgggaggtgattgccgattcgatcgaaacggtcgtcaacgggcaaagcatggatgccctgctggcgatcggtggctgtgacaagaacatgcctggtgccatgctggcgatggcgaggatgaacgtcccctcgatcttcgtgtatggcggcaccatcaagcctggcaagctcggtgcctgtgacctcaccgtggtgagtgcctttgaggcggtgggccagttcagtggcggcaagatcgaggagcaggaactcacggcgatcgagaaaaacgcctgccctggggcgggcagctgcgggggcatgtttactgccaacaccatgagtgccgccttcgaggtgctggggctgagcttgccctacagctccacgatggcggccgaagaccccgagaaggccgatagcgccgcccgtagtgccgaggttttggccgacgccatcgaggcccagatcctcccgcgcgatctgatgacgcgcgaagccttcgaaaacgccatcagtgtgatcatggccgtgggtggctccaccaactccgtgctgcatctgctggctgtcgcccgcacggcgggggtggcgctgagcattgacgacttcgagcggatccggcagcgcgtgccggtgatctgtgatctcaagccaagtggccgcttcgtgacggtggatctgcaccgggctgggggcattccccaggtgatgaaactactgctcgatgcagggctcttgcacggcgactgccgcacgatcgaaggcaagacccttcacgaggtgctcgccgctgtgccgtcggtcccccccgccggccaggaggtgattcggcccctgagccatccgctgtatgccaaggggcacctggcgatcctcaaaggcaacctggccgaggaaggcgcggtggccaagatcagcggcgtcaaaaacccggtcatcaccggccctgcccgcgtgttcgagagcgaagaaacctgcctggccgccattctcgacaagcagatcaaccccggcgatgtggtggtcgtgcgcaatgaggggccggtgggcggtcctggcatgcgggagatgctcagccccacctccgcgatcgtgggccaggggctgctcgacaaggtggctctgatcaccgatggccgcttctcaggcggttcctacggcctggtgatcggccacgtggctccggaggccgccgtggggggcacaatcggcctggtgcaggaaggcgacagcatcaccgtggatgcgaatcagctgctgattcaactcaacgtggatgaatccgagctagctcaacgtcgcgccgcctggacccaacccgaaccccggtatcgcaccggcatcctcggcaaatacgcccgacaggtgagctccagcagtgtgggggcggtgaccgatcagccctga

SEQ ID NO: 266 - protein, 556 aa, Synechococcus sp.
MLRSAAITQGIQRSPNRAMLRAVGFGDGDFNKPIIGIANGYSTITPCNLGLNDLARRAEEAAHQVGAMPQMFGTITVSDGISMGTEGMKYSLVSREVIADSIETVVNGQSMDALLAIGGCDKNMPGAMLAMARMNVPSIFVYGGTIKPGKLGACDLTVVSAFEAVGQFSGGKIEEQELTAIEKNACPGAGSCGGMFTANTMSAAFEVLGLSLPYSSTMAAEDPEKADSAARSAEVLADAIEAQILPRDLMTREAFENAISVIMAVGGSTNSVLHLLAVARTAGVALSIDDFERIRQRVPVICDLKPSGRFVTVDLHRAGGIPQVMKLLLDAGLLHGDCRTIEGKTLHEVLAAVPSVPPAGQEVIRPLSHPLYAKGHLAILKGNLAEEGAVAKISGVKNPVITGPARVFESEETCLAAILDKQINPGDVVVVRNEGPVGGPGMREMLSPTSAIVGQGLLDKVALITDGRFSGGSYGLVIGHVAPEAAVGGTIGLVQEGDSITVDANQLLIQLNVDESELAQRRAAWTQPEPRYRTGILGKYARQVSSSSVGAVTDQP

SEQ ID NO: 267 - DNA, 1617 bp, Synechococcus sp.
atgttgcgggccgtgggcttcggcgacggtgacttcaacaagccgatcatcggcatcgccaatggctacagcacgatcacgccctgcaacatcggcctgaacgatctggcccgctgcgccgaggagtctgcccgtctggctggggccatgccacagatgttcggcacgatcaccgtcagcgacgggatctcgatgggcaccgaggggatgaagtattccctggtgagccgggaggtgatcgctgattcgatcgaaaccgcctgcaacgcccagagcatggatggcctgctggccatcggcggctgcgataagaacatgcccggcgccatgctggcgatggcgcgcatgaacatcccggcgatcttcgtgtacggcggcacgatcaaacccggccggctcggcccctgcgacctcaccgtggtgagtgccttcgaggctgttggtcagttctcgggcggtcgcatcgatgaggaggaactgctggcgatcgagaagaacgcctgccccggcgccggcagctgcggcggcatgttcaccgccaacacgatgagttcggcgttcgaagcgatgggcctgagcctgccgggcagctccaccatgacggccgaggatccggagaaggccgagagcgctgcccgctccgccgaggtgctggtgcgggccatcgaggcgaacatccgcccccgtgatctgatcacccgcgaggcgatcgagaacgccatcagcgtgatcatggcggtgggggggtccaccaattcggtgctgcacctgctggcgatcgcccgcaccgccgaggtgccgctcacgatcgacgatttcgagacgatccgtcagcgggtgccggtgatctgcgatctcaagcccagcggccgtttcgtgacggtggatctgcaccgggccggcggcattccccaggtgatgaagctgctgctggatgccggcctgctgcacggcgattgccgcaccatcgaaggcctcacgctcaagcaggtgctggcggaggtgcccagcgagccccccgccgatcaggacgtgatccggcccctctccaatccgctctatgccaagggtcacctggcgatcctcaagggcaacctggccgaggaaggggccgtcgccaagatcagtggcgtcaagaccccggtgatcacggggccggcccgggtgttcgagagtgaggagagcgccctggaggcgatcctcgccggtgaggtccatgccggtgatgtggtggtggtgcgctacgagggcccggtgggcgggcccggcatgcgtgagatgctctcgcccacggccgcgatcgtgggccagggcctgggggaatcggtggcgctgatcaccgacggtcgcttcagcgggggctcctacggcctggtggtgggccatgtggcccccgaggccgccgtgggcggcaccatcgccctggtgcaggagggcgacagcatcaccgttgatgcccatcagctgctcatccagctcaatgtggaaaccagcgagctggagcggcgccgggcggcctgggtcaggcccgaaccgcgctaccgcactggagtgctgggcaagtacgcccggctggtgagcagcagcagcctgggggcggtcaccgatcagggttga

SEQ ID NO: 268 - protein, 538 aa, Synechococcus sp.
MLRAVGFGDGDFNKPIIGIANGYSTITPCNIGLNDLARCAEESARLAGAMPQMFGTITVSDGISMGTEGMKYSLVSREVIADSIETACNAQSMDGLLAIGGCDKNMPGAMLAMARMNIPAIFVYGGTIKPGRLGPCDLTVVSAFEAVGQFSGGRIDEEELLAIEKNACPGAGSCGGMFTANTMSSAFEAMGLSLPGSSTMTAEDPEKAESAARSAEVLVRAIEANIRPRDLITREAIENAISVIMAVGGSTNSVLHLLAIARTAEVPLTIDDFETIRQRVPVICDLKPSGRFVTVDLHRAGGIPQVMKLLLDAGLLHGDCRTIEGLTLKQVLAEVPSEPPADQDVIRPLSNPLYAKGHLAILKGNLAEEGAVAKISGVKTPVITGPARVFESEESALEAILAGEVHAGDVVVVRYEGPVGGPGMREMLSPTAAIVGQGLGESVALITDGRFSGGSYGLVVGHVAPEAAVGGTIALVQEGDSITVDAHQLLIQLNVETSELERRRAAWVRPEPRYRTGVLGKYARLVSSSSLGAVTDQG

SEQ ID NO: 269 - DNA, 1671 bp, Prochlorococcus marinus
atgctcagatccgccgccatcacaaagggaactcaacgctctcccaaccgagccatgcttcgcgcagtgggctttggcgacgaagacttcaataaaccaatcatcggtatagccaacggctacagcacgatcactccttgcaacatcggtcttaatgacctggcgcgacgttcagaagaagcagcccgccaggccggtgcaatgccccagatgttcggcaccatcactgtcagtgatggcatctctatgggcaccgaagggatgaaatattccctggtaagtcgcgaggtgattgctgattcgatcgagacagcctgcaacgcccaaagcatggacggcgtactagcaatcggtggctgtgacaaaaacatgcctggagcgatgatcgccctggcccgaatgaacatcccaggtgtctttgtctatggcggaacgatcaaaccaggaaaattggctgaccgcgacctcactgtagtcagcgcctttgaagctgttggtcagcatgccagtggcaagataaatgaggagcaactcaccgctatcgagaagaacgcttgcccaggagcaggaagttgcggtggcatgtttacagccaacacgatgtcagccgctattgaaacattgggattgagtttgccttacagctcaacgatggctgcagaggatgaggaaaaagcaaatagcgcagcccgtagtgctgaagtgcttgtggatgccattaaggcaaatatctgtccccgcgatctactcaccaagaacgcatttgaaaacgcgattagcgttgtcatggcagtgggcggctccaccaatgcagttctgcatctgcttgcgattgcccgtagcgcaggcgtagacctttgcatcgatgacttcgagcgcatccgccagcgtgtaccggtgatttgtgatctaaaacccagcggccgttacgtgactgttgatttgcataacgcaggcggcattccccaagtgatgaaacagttgcttgatgcaggcttacttcatggagactgccgcaatgtggaaggtaaaaccttgagagaactgctcaaggatgtgccatccgagccttcagcagagcaagacgtcattcatcccctctcgaaaccggtctatgccaaggggcacctggcgatccttaaaggcaatctggccagcgaaggatgcgtggccaagataagcgggatcaaaaccccagtacttactggacctgcaagggtttttgaaagcgaggaggcctgccttgctgccattctcaacaacaaggtgaaggcgggagatgtcgtcgtcatacgtaacgaaggcccggttggcgggcctggaatgcgagagatgcttgctcctacatctgccatcgtcggtgaagaccttggcgacaaggtggccttaatcacagatggacgcttcagcggaggtacctatggtttggtggtgggccatgtggcaccggaagcagccgtaggcggcatgattggccttgtgcaggaaggcgacagcatcaccatcgatgccaatcaactgctgatccaactcaatgtcgagaaggatgaattggagcgtcgctccagcgcatgggaaaaaacacagccgcgttatcaaacaggagttctcggtaaatacgcccgaatggtgagtagcgccagcaatggtgctgtcaccgaccagccctga

SEQ ID NO: 270 - protein, 556 aa, Prochlorococcus marinus
MLRSAAITKGTQRSPNRAMLRAVGFGDEDFNKPIIGIANGYSTITPCNIGLNDLARRSEEAARQAGAMPQMFGTITVSDGISMGTEGMKYSLVSREVIADSIETACNAQSMDGVLAIGGCDKNMPGAMIALARMNIPGVFVYGGTIKPGKLADRDLTVVSAFEAVGQHASGKINEEQLTAIEKNACPGAGSCGGMFTANTMSAAIETLGLSLPYSSTMAAEDEEKANSAARSAEVLVDAIKANICPRDLLTKNAFENAISVVMAVGGSTNAVLHLLAIARSAGVDLCIDDFERIRQRVPVICDLKPSGRYVTVDLHNAGGIPQVMKQLLDAGLLHGDCRNVEGKTLRELLKDVPSEPSAEQDVIHPLSKPVYAKGHLAILKGNLASEGCVAKISGIKTPVLTGPARVFESEEACLAAILNNKVKAGDVVVIRNEGPVGGPGMREMLAPTSAIVGEDLGDKVALITDGRFSGGTYGLVVGHVAPEAAVGGMIGLVQEGDSITIDANQLLIQLNVEKDELERRSSAWEKTQPRYQTGVLGKYARMVSSASNGAVTDQP

SEQ ID NO: 271 - DNA, 1671 bp, Prochlorococcus marinus
atgcttagatcaaatgcaataacacagggtattcaacgatcaccaaaccgagcaatgcttagagctgttgggtttgatgataatgattttaacaagccaatcattggaatagctaatgggcacagcacaataaccccatgcaatatgggattaatggatttagctaatagagcagagtcagcgttaaaagaggctggtgcaatgcctcaaactttcggaaccataactgttagtgacggcatttccatgggaacggaagggatgaaatactcattagtttcaagagaagttattgcagattcaatcgagacggcttgcaatgctcaaagcatggatggggtgttagcgataggtggatgcgataaaaatatgccaggagcaatgttatcaatggcaagaatgaacataccttcgatttttgtttatggggggacaattaaacctgggaaattagacggttgcgacttgaccgtggtgagttcatttgaggctgtcggtcaattagcaagcggaaaaatcgacaaagatcgtttaatagctgtagaaaaaaatgctatccctggaccaggcagttgcggagggatgtttactgctaataccatgtctgcggcaatagaaacgatgggttttagtttgccatttagttcaacaatggctgcagtagatgatgaaaaagcagaaagcgctgctgaaagtgctcaggtccttgtaaatgcagtaaagaataacatcaggccattagatttacttacgaaagaagcctttgagaatgcaatcagtgtcatcatggctgtaggcggctcaacaaattctgtccttcacctacttgctatagctaggactgcaggagttgatttaacgatcgatgactttgaacgtataaggcagactgttcctgtgatttgcgacctcaaaccaagcggtaaatacgtaacagtcgacctacataaagctggtgggattcctcaagtaatgaaattactcctcgatgcaggaatgctacatggagaatgcaaaaccattgaaggaaaaacaattaaagaagttcttagagatatcccctcaaagcccaaagaaaatcaagacgttataagacaaatatcaaaccctatttataaaaaaggacatcttgctattctcaaaggaaatttagcaagtgaaggaagtgtcgcaaaaattagtggtgtaaagactcccgttttaaccgggcctgcaagggtctttgagagtgaagaagaatgcttaactgccattcttgacaataaagtaaaagctggagatgtagtcgtcgttaggtatgaaggacctgtaggagggcctgggatgagggagatgctctctccaacctcagcgattgtaggtcaaggtttaggagagaaagttgcactaattactgatggtcgatttagtggaggatcatatggattagtggttggccacgttgctccagaagcagccgtcggaggaacaattggattagtagaggaaggagacagtattaccgttgacgctaataaattgttaattcaattaaatgtcgaagagcgagaactagctagaagaaaacagaaatgggagaagccaaagcctagatataagacaggcattcttgggaagtattccagattagtaagttcatcaagccaaggagcgacaactgatcaaatataa

SEQ ID NO: 272 - protein, 556 aa, Prochlorococcus marinus
MLRSNAITQGIQRSPNRAMLRAVGFDDNDFNKPIIGIANGHSTITPCNMGLMDLANRAESALKEAGAMPQTFGTITVSDGISMGTEGMKYSLVSREVIADSIETACNAQSMDGVLAIGGCDKNMPGAMLSMARMNIPSIFVYGGTIKPGKLDGCDLTVVSSFEAVGQLASGKIDKDRLIAVEKNAIPGPGSCGGMFTANTMSAAIETMGFSLPFSSTMAAVDDEKAESAAESAQVLVNAVKNNIRPLDLLTKEAFENAISVIMAVGGSTNSVLHLLAIARTAGVDLTIDDFERIRQTVPVICDLKPSGKYVTVDLHKAGGIPQVMKLLLDAGMLHGECKTIEGKTIKEVLRDIPSKPKENQDVIRQISNPIYKKGHLAILKGNLASEGSVAKISGVKTPVLTGPARVFESEEECLTAILDNKVKAGDVVVVRYEGPVGGPGMREMLSPTSAIVGQGLGEKVALITDGRFSGGSYGLVVGHVAPEAAVGGTIGLVEEGDSITVDANKLLIQLNVEERELARRKQKWEKPKPRYKTGILGKYSRLVSSSSQGATTDQI

SEQ ID NO: 273 - DNA, 1674 bp, Prochlorococcus marinus
atgaataaacttagatcatctgctattacccaaggtgtgcaaaggtcacctaacagatcaatgttaagggcagttggttttaatgatgaagattttaacaaacctattattggggttgccaatggttacagcacaataaccccatgcaatatagggttaaataaattagctctcaaagctgaagagtcaattagacgatcagggggaatgcctcaaaaattcgggaccatcactgtaagtgatggcatttccatgggaacagaggggatgaaatattcattagtttcaagagaagtaatagctgactcgattgaaacagcatgtaatgctcaaagtatggatgcagtacttgctataggtggatgcgataaaaatatgcctggagcaatgatagcgattgcgaggatgaatattccctcaatatttatctatggaggaactataaaaccaggcaaattacatggggaagatcttacggttgttagtgcgttcgaagctgttggacagttaacatcaggcaaaattaatgagaaaaggttaatcgaagttgagaaaaattgtatccctggagctggaagctgtgggggaatgtttacggctaatacaatgtctgcagtaatagaagtgttaggtttaagccttccacacagttcaactatggctgctgaagatcttgaaaaagaactaagtgcagaaaaaagtgctgagatattagtatctgcgattaaaaaaaatataagaccattagacttaatgactaaaaaagcatttgaaaatgcaatatcagtaattatggccgtaggaggttcaacgaatgcagtattacatatattagcaatagcaaatactgcaggtattgatattaatattgatgactttgagaggataagacaaaaagttcctgtaatttgtgaccttaagccaagtggaaaatttgtaacagttgatcttcataatgcagggggaattccccaagttatgaaaatactcctaaatgcaggattaattcatggggaatgcaaaaacattgaaggcaaaactataactgaatacttacaaaacattccagataagcctcctagtaatcaaaatgtcatccgaggaatagattatcccctttataaaaaagggcatttagcaattttaaaagggaacctggcaaaggaaggttctgtagcaaaaattagtggagtaaaaaatccagttttaacaggtccagcaaagatattcgagagtgaagaagattgtcttaaagcaatcttaaataacgaaattatagctggtgatgttgttgttgtaagaaatgaaggtcctgtcggaggtccagggatgagagaaatgttatccccaacatcagcaattgttggacaaggacttggagaaaaagtggccttaattactgatggtaggtttagcggtggctcttatggtcttgttgtcgggcatatagcccctgaagcagctgtcggtggaaacattgctctaataaaagaaggtgatttgattacagttgatgctgtaaagcaactaattgaggttgatttatctgacgaagaattagaaaaaagaaaaaataattgggtaaaacctaaacctaaatataaaagaggaatactttcaaagtattcgaaaatagtaagtacatcaagtttaggggctgttactgatttatag

SEQ ID NO: 274 - protein, 557 aa, Prochlorococcus marinus
MNKLRSSAITQGVQRSPNRSMLRAVGFNDEDFNKPIIGVANGYSTITPCNIGLNKLALKAEESIRRSGGMPQKFGTITVSDGISMGTEGMKYSLVSREVIADSIETACNAQSMDAVLAIGGCDKNMPGAMIAIARMNIPSIFIYGGTIKPGKLHGEDLTVVSAFEAVGQLTSGKINEKRLIEVEKNCIPGAGSCGGMFTANTMSAVIEVLGLSLPHSSTMAAEDLEKELSAEKSAEILVSAIKKNIRPLDLMTKKAFENAISVIMAVGGSTNAVLHILAIANTAGIDINIDDFERIRQKVPVICDLKPSGKFVTVDLHNAGGIPQVMKILLNAGLIHGECKNIEGKTITEYLQNIPDKPPSNQNVIRGIDYPLYKKGHLAILKGNLAKEGSVAKISGVKNPVLTGPAKIFESEEDCLKAILNNEIIAGDVVVVRNEGPVGGPGMREMLSPTSAIVGQGLGEKVALITDGRFSGGSYGLVVGHIAPEAAVGGNIALIKEGDLITVDAVKQLIEVDLSDEELEKRKNNWVKPKPKYKRGILSKYSKIVSTSSLGAVTDL

SEQ ID NO: 275 - DNA, 1674 bp, Prochlorococcus marinus
atgaataaactcagatcatctgcaataacccaaggtgtgcaaagatcacctaacagatcgatgttaagagctgttggatttaatgatgaagattttaataaacctattattggagttgcaaatggatacagcaccataacaccatgcaatatgggtttaaataagttagctctaaaagctgaagagtctataaaaagatcaggtgggatgcctcagatgtttgggactataacagtaagtgatgggatttctatgggaacagagggcatgaaatattccctagtttcaagagaagttattgctgattcaattgaaacagcatgcaatgctcagagtatggatggagtacttgctataggtggatgtgataaaaatatgccgggtgccatgattgcgattgcaagaatgaatattccatcaattttcatttatggaggaacaataaagcctgggaaattgcatggagaagatcttactgttgttagtgcatttgaagctgttggacaattaacatcaggcaaaattaatgaagaaaggctaatccaagttgagaaaaattgtattcctggtgctggtagctgtggaggaatgtttacagctaatacaatgtctgcggttattgaagtattagggttaagtcttcctcacagttccactatggctgctgaagatcttgaaaaagaactaagtgcagacaaaagtgctgagatattagtctccgcaatagaaaaagatataagacctctagacctaatgactaagaaagcatttgaaaatgcaatatcagtaattatggcaattggcggatcaacaaatgcggtattgcacatcttagctatcgcgaatactgcaggaatagatatcaacattaatgattttgagagaatcagacaaaaagtacccgttatttgtgaccttaaaccgagtggtaaatatgtgacggtggatcttcataaggcaggtgggattccacaagtaatgaaaatacttttgaatgcaggattaattcatggcgattgcaaaaacattgaaggaaaaaccatctcagaatacttacaaaatattccagataagcctccaacaaatcaaaatgtcataagagacatagataaccctctttataaaaaaggacatctagcgatattaaaaggtaacttagcgagcgaaggttctgtagccaaaattagcggagtaaaaaaccctgtattaacaggtcccgcaaaaatttttgaaagtgaagaagattgtttaaaatcgatattaaataacgatatcaaagctggtgatgttgttgttattagaaacgaaggtcctgtaggaggaccaggtatgagagagatgttagctccaacatctgcaattgttggtcaagggctaggagagaaggtggctttaattaccgatggcagatttagcggcggtacctatggtcttgttgtgggtcacatagctccagaggctgctgtaggaggaaatattgctctaataaaacaaggtgatttaattacagtagatgctgtaaaacaactaattgaagttgatttatctgacgaagaattagaaaaaagaaaaaaagattgggtaaaacctattcaaaaatacaaaagaggaattctttcaaaatattcgagaatcgtaagcacatcaagtttaggggctgttactgatttataa

SEQ ID NO: 276 - protein, 557 aa, Prochlorococcus marinus
MNKLRSSAITQGVQRSPNRSMLRAVGFNDEDFNKPIIGVANGYSTITPCNMGLNKLALKAEESIKRSGGMPQMFGTITVSDGISMGTEGMKYSLVSREVIADSIETACNAQSMDGVLAIGGCDKNMPGAMIAIARMNIPSIFIYGGTIKPGKLHGEDLTVVSAFEAVGQLTSGKINEERLIQVEKNCIPGAGSCGGMFTANTMSAVIEVLGLSLPHSSTMAAEDLEKELSADKSAEILVSAIEKDIRPLDLMTKKAFENAISVIMAIGGSTNAVLHILAIANTAGIDININDFERIRQKVPVICDLKPSGKYVTVDLHKAGGIPQVMKILLNAGLIHGDCKNIEGKTISEYLQNIPDKPPTNQNVIRDIDNPLYKKGHLAILKGNLASEGSVAKISGVKNPVLTGPAKIFESEEDCLKSILNNDIKAGDVVVIRNEGPVGGPGMREMLAPTSAIVGQGLGEKVALITDGRFSGGTYGLVVGHIAPEAAVGGNIALIKQGDLITVDAVKQLIEVDLSDEELEKRKKDWVKPIQKYKRGILSKYSRIVSTSSLGAVTDL

SEQ ID NO: 277 - DNA, 1680 bp, Prochlorococcus marinus
atgaataaattaagatcttctgcaataactcaaggtgttcaaagatctcctaacagatcaatgttaagagcagttggatttagtgatgatgatttcactaaaccaatcattggagtcgctaatggatatagcaccattacaccctgcaatatgggccttaacaagttagctcttaaggcagaagattcaataaggaaatcaggaggaatgcctcaaatgttcggaactatcaccgtaagcgatgggatctccatgggaacagaaggaatgaaatattctttagtttcaagggaagtaatagccgattcaatagaaactgcctgtaatgcgcaaagtatggatggtgttttagctattggtggttgtgataaaaatatgccgggtgcaatgatagcaattgcaagaatgaatatcccttccatatttatttatggaggaacaataaaacctggaaagttaaacggtgaagacttaacggttgtcagtgcatttgaagctgttgggcaattaacctcgggtaaaataaatgagaagagattaaatgaagttgagaaaaattgtattccaggagcaggaagttgtggaggaatgttcacagctaatactatgtcagcagttatagaagtcttaggtttaagtcttcctcatagttcaacaatggcagccgaagattatgagaaggtggtaagtgctgaaaaaagcgctgaaatacttgtagatgcaataaaaaaagatataaggccactagatcttatgactaaagaatcttttgaaaatgcaatatctgtaattatggctattggaggttcgacaaatgcagtgcttcacatattagcgatagcgaatactgcaggtatagagatcaatattgatgattttgaaagaataagacaaaaagttcctgtgatttgtgatttgaaacctagcggcagatatgtcacagtagatcttcataatgcaggaggcattccacaagtaatgaaaatacttttaaatgcaggattaataaatggtgattgcaaaaatatcgaaggtaaaacaatatctgaatatttacttaatattccagataatcctcctgaaaatcaaaatgttattagaaacataaataatcctctttataaaaaaggtcatttagcaatattaaaaggtaatttagcttcggaaggttgtgtagcaaaaatcagcggagtaaagaatccagttttaaagggtcccgctcgaatttttgaaagtgaggaagattgtcttaaatcaattttgaataatgatattaaagctggtaatgttgtcgttataagaaatgaaggtcctgtgggaggaccgggaatgagagaaatgttagctccaacatctgcaattgttgggcaagggctgggagaaaaagtagctttaataactgatggtagatttagtggaggtacctatggccttgttgttggacatatcgcaccagaggcagcagtaggagggaatatagctttaataagagagggagatttaatcactgttgatgctgtaaaccaattaattgaagttgaactatctgatggggaattagaaaaaagacgaattaactggataaagcctattccgaaatataagaaaggtgtactttcaaaatattcaagaattgtaagtacttcaagcttaggtgcagttacagatctggaaaaataa

SEQ ID NO: 278 - protein, 559 aa, Prochlorococcus marinus
MNKLRSSAITQGVQRSPNRSMLRAVGFSDDDFTKPIIGVANGYSTITPCNMGLNKLALKAEDSIRKSGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLNEVEKNCIPGAGSCGGMFTANTMSAVIEVLGLSLPHSSTMAAEDYEKVVSAEKSAEILVDAIKKDIRPLDLMTKESFENAISVIMAIGGSTNAVLHILAIANTAGIEINIDDFERIRQKVPVICDLKPSGRYVTVDLHNAGGIPQVMKILLNAGLINGDCKNIEGKTISEYLLNIPDNPPENQNVIRNINNPLYKKGHLAILKGNLASEGCVAKISGVKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIREGDLITVDAVNQLIEVELSDGELEKRRINWIKPIPKYKKGVLSKYSRIVSTSSLGAVTDLEK

SEQ ID NO: 279 - DNA, 1680 bp, Prochlorococcus marinus
atgaataaattaagatcatctgcaataactcaaggtgtccaaagatctcctaacagatcaatgttaagagctgttggttttagtgatgaagattttactaaacctataattggagttgctaacggatttagtactatcacaccatgcaatatgggtctaaacaagttagctctaaaagctgaagaatcaataagagaagcaggaggtatgcctcagatgttcggaaccatcaccgtaagtgatggaatctctatgggaacagagggaatgaaatattccctagtttcaagagaggttatagctgattcaatcgaaacagcatgcaatgcgcaaagtatggatggggttttagctattggaggttgtgataaaaatatgccaggagcaatgattgcaattgcaagaatgaatatcccatccatatttatttatggaggaacaataaaacctggtaaattaaatggtgaagatcttacagttgtcagtgcatttgaagctgttgggcaattaacttctgggaaaataaatgagaagagattaattgaagttgaaaaaaattgtatcccaggagctggaagttgtggaggaatgtttacagctaacactatgtctgctgttatagaagtcttgggtttaagtcttccatatagttcaacaatggcagctgaagattacgaaaaggaagttagcgctgaaaaaagtgctgaaatattagttgatgcaattagaaaagatattagacctttaactctcatgactaaagaatcatttgagaatgcaataactgtcattatggctattggaggttcaactaatgccgttctccatatattagcaatagcaaatacagcaggtatagatatcaatattgatgatttcgaaagaataagacaaaaagtacctgtaatttgcgacttaaaacccagcggtaaatacgtaacagtcgatcttcataaagcaggtggaattccacaagttatgaaaatacttctaaacacaggtttgatacatggtaattgtagaaacatagagggtaaaacagtagttgaatccttaaaagatattccagttaaacctccagagaatcaggatgtcattcgagatattgataatccactttataaaaaaggtcacttagcgattctaaaagggaacttagcctcggaaggttgtgtagccaaaattagtggaataaagaatcctgtattaaaaggacctgctcgcatctttgagagtgaggaggattgtctcaaatcaattttgaataatgatattaaagctggtaatgttgttgttataagaaatgaaggtcctgtgggcggaccagggatgagagaaatgttggcaccaacatccgcaattgttgggcaaggacttggagaaaaagtagcgctaataactgatggtagatttagtggaggcacctatggcctagttgttggccacattgcaccagaggcagcagttggaggaaatatagcgttaataaaagaaggcgatttaataactgttgatgctacaaaccaattaatcgaagttgaactatctgatgaggaattagaaatgagaagaattaactgggaaaagcctagtaaaaaatataaaaaaggagttctttctaaatattcaagaattgttagcacctcaagcctaggagccgttacagatttggaagaataa

SEQ ID NO: 280 - protein, 559 aa, Prochlorococcus marinus
MNKLRSSAITQGVQRSPNRSMLRAVGFSDEDFTKPIIGVANGFSTITPCNMGLNKLALKAEESIREAGGMPQMFGTITVSDGISMGTEGMKYSLVSREVIADSIETACNAQSMDGVLAIGGCDKNMPGAMIAIARMNIPSIFIYGGTIKPGKLNGEDLTVVSAFEAVGQLTSGKINEKRLIEVEKNCIPGAGSCGGMFTANTMSAVIEVLGLSLPYSSTMAAEDYEKEVSAEKSAEILVDAIRKDIRPLTLMTKESFENAITVIMAIGGSTNAVLHILAIANTAGIDINIDDFERIRQKVPVICDLKPSGKYVTVDLHKAGGIPQVMKILLNTGLIHGNCRNIEGKTVVESLKDIPVKPPENQDVIRDIDNPLYKKGHLAILKGNLASEGCVAKISGIKNPVLKGPARIFESEEDCLKSILNNDIKAGNVVVIRNEGPVGGPGMREMLAPTSAIVGQGLGEKVALITDGRFSGGTYGLVVGHIAPEAAVGGNIALIKEGDLITVDATNQLIEVELSDEELEMRRINWEKPSKKYKKGVLSKYSRIVSTSSLGAVTDLEE

SEQ ID NO: 281 - DNA, 1671 bp, Prochlorococcus marinus
atgcttcgatccagtgcaatcacccaaggaattcagagatcaccaaatagggctatgctccgagcggttggatttaatgataatgattttaacaagccaataattggtattgctaatgggtacagcacaattacaccatgcaatgttggattaaataacctagccctacacgcagaagcctcaacaaaagtatcaggcgctatgccacaaatgtttggcacaataactgttagcgatggaatatctatggggaccgaagggatgaaatattcactagtttcaagagaggttatagccgattcaatagagacagcatgtaatgctcaaagcatggacggtgttcttgcaataggaggatgtgataaaaatatgcctggagccatgattgccatggcaagaatgaatatacccgcaattttcgtgtatggagggacaattaaaccagggaaattagacggttgtgatttaacagtagtaagtgcatttgaagccgttgggcaattaacaagtggaaagattactgaagataaacttattgctgtagaaaagaattgtattcctggagcaggaagttgtggaggaatgttcacagctaataccatgtccgcagcaatagaaacgctcggattaagcttgccttatagctcaacaatggctgctgaagataaggaaaaaatagagagtgctgagcgtagtgccaaagtcctggtagatgcaattgaaaaaaatatacgtcctttagacctcctaaccaagaaatcatttgaaaatgctattgccgtagtcatggctgttggcgggtcgacaaatgccgtattacatttattagctattgctaggtcatcaggagtggacttatgcatagatgattttgaaagaattcgacagaaggtacctgtgatttgtgatttaaagccaagtggcaaatatgtcactgtagatctacataaagctggtggaatacctcaggtaatgaagctgcttttagatgcgggcttattacatggtgattgtttaactattgaaggtataactatcgatgagtccttaaaaaatatcccttcagagccaccagcgaaccaaaatgtgatatctccaatcacaaagccaatatataaaaaaggacatctagcaatcttaaaaggaaatctcgcaaccgaaggatgcgtagccaaaataagtgggattaggaccccagtgttgaaaggtccagcaaaagtatttgaaagtgaagaagactgtctcgacgcaatcttaaaagaacagatacaagaaggagatgtaatagttattagaaacgaaggccctgtaggaggacccggaatgagagaaatgttagcaccaacctctgccatagttggacaaggcctaggggataaggttgctctaataacagatggacgttttagcggtggtacttatggtttggtagtgggacatatagcaccagaagcatcagtgggagggaatatagccctagtcaaagaaggtgacatgattactgttgacgcgcacaaaaagttgattcaattggaagtagatgaaaaggagctctcaaaaaggaggactttatgggaaaaaccagaagttaaatataagactggaatactaggtaaatatgcgcgtttagttagcagttcaagcaagggtgctgtaactgatcaaccatga

SEQ ID NO: 282 - protein, 556 aa, Prochlorococcus marinus
MLRSSAITQGIQRSPNRAMLRAVGFNDNDFNKPIIGIANGYSTITPCNVGLNNLALHAEASTKVSGAMPQMFGTITVSDGISMGTEGMKYSLVSREVIADSIETACNAQSMDGVLAIGGCDKNMPGAMIAMARMNIPAIFVYGGTIKPGKLDGCDLTVVSAFEAVGQLTSGKITEDKLIAVEKNCIPGAGSCGGMFTANTMSAAIETLGLSLPYSSTMAAEDKEKIESAERSAKVLVDAIEKNIRPLDLLTKKSFENAIAVVMAVGGSTNAVLHLLAIARSSGVDLCIDDFERIRQKVPVICDLKPSGKYVTVDLHKAGGIPQVMKLLLDAGLLHGDCLTIEGITIDESLKNIPSEPPANQNVISPITKPIYKKGHLAILKGNLATEGCVAKISGIRTPVLKGPAKVFESEEDCLDAILKEQIQEGDVIVIRNEGPVGGPGMREMLAPTSAIVGQGLGDKVALITDGRFSGGTYGLVVGHIAPEASVGGNIALVKEGDMITVDAHKKLIQLEVDEKELSKRRTLWEKPEVKYKTGILGKYARLVSSSSKGAVTDQP

SEQ ID NO: 283 - DNA, 1677 bp, Prochlorococcus marinus
atgaagcttagatcaagcgcaataactcaaggcgtacagagatcgccaaacagagcaatgcttcgtgctgttgggtttgaagacgatgatttcaacaaaccaataataggtattgcaaatgggtatagcactatcacgccttgtaatattgggctaaatgatttggcaaaacaagcagaaaaagcaataaaggattgggatggtatgcctcaaatgtttggaacaattactgttagtgatggaatatctatggggactgaagggatgaaatactccttggtctctagagaagtaatagccgattcaatagaaactgcatgcaatgctcaaagcatggatggagtgttagcaataggtggttgcgataaaaacatgcctggtgcaatgctagccatggcaagaatgaatattccagggatatttgtttatgggggaacgatcaaaccaggaaaattaaatggcgaggatttgacagttgtaagtgcatttgaagctgtggggcaattaactagtgggaaaataacaaaagaaaaattgattgaggttgaaaaacattgcattccaggggctggtagttgtggaggtatgtttacagcaaacacaatgtcagcagccattgaagctatgggactaagtcttcctcacagttcaaccatggctgctgaggatcaagaaaaaataaaaagtactcaaaaaagtgccgaggttcttattaaagctatcaaggaaaatattcgcccattagatttattaaccaagcaagcattcgagaatgcaataagtgtagtaatggcagttgggggctctacaaatgctgtgcttcatcttttagcaattgctcattcatcgggagttgaactttctcttgacgaatttgaaaagatacgtcaacgagttccggtactttgtgatttaaagcccagtggtaaatatgtgactgttgacctacacaaagcaggaggcattccacaagtcatgaaaatacttcttgaagcaggattgattaatgaaaattgtagaacaatagaaaacaaaacaatcaaggaaatgctgctcgatgttcccgcagagcccccatcagatcaggatgttattcggcctttcgattcgccggtctataaaaaaggtcatttagcaattctcaaaggaaatcttgcaactgagggaagcgttgcaaaaatcagtggtataaaagaaccaatccttacaggtccagcaaaagtatttgaaagtgaagaagattgcttaaaagcaatacttactgaacaaattcactcaggtgatgtagtagtcataagaaatgaaggcccagttggtgggccagggatgagagaaatgctcgctccaacatctgcaattgttggtcaaggtcttggtgaaaaagttgctttaattactgacggacgttttagtggcggaacatatggactagtagttggtcatgtcgcaccagaagcagccgttggagggaatattgctctaattcaagatggtgacagcataactgttgatgctattcaaaaactcattcaagtaaatatcgaagaagcagaattaaaaagacgacgttcactttgggttaagccaaagcccaaatacaattcaggagttcttgggaaatatgcaactttggttagtagttcaagcaaaggtgctgtaactgatcagaactgttaa

SEQ ID NO: 284 - protein, 558 aa, Prochlorococcus marinus
MKLRSSAITQGVQRSPNRAMLRAVGFEDDDFNKPIIGIANGYSTITPCNIGLNDLAKQAEKAIKDWDGMPQMFGTITVSDGISMGTEGMKYSLVSREVIADSIETACNAQSMDGVLAIGGCDKNMPGAMLAMARMNIPGIFVYGGTIKPGKLNGEDLTVVSAFEAVGQLTSGKITKEKLIEVEKHCIPGAGSCGGMFTANTMSAAIEAMGLSLPHSSTMAAEDQEKIKSTQKSAEVLIKAIKENIRPLDLLTKQAFENAISVVMAVGGSTNAVLHLLAIAHSSGVELSLDEFEKIRQRVPVLCDLKPSGKYVTVDLHKAGGIPQVMKILLEAGLINENCRTIENKTIKEMLLDVPAEPPSDQDVIRPFDSPVYKKGHLAILKGNLATEGSVAKISGIKEPILTGPAKVFESEEDCLKAILTEQIHSGDVVVIRNEGPVGGPGMREMLAPTSAIVGQGLGEKVALITDGRFSGGTYGLVVGHVAPEAAVGGNIALIQDGDSITVDAIQKLIQVNIEEAELKRRRSLWVKPKPKYNSGVLGKYATLVSSSSKGAVTDQNC

SEQ ID NO: 285 - DNA, 1707 bp, Nodularia spumigena
atggaaggaaaaaaaatgtcggagaatttaagaagccaagttgttacccaaggagtgcagcgatcgcctaatcgagctatgctgcgtgcagtgggttttaaggacgaagattttaataaagccattgtcggcattgctaatggctacagtacaatcactccctgcaatatgggaattaataaactagcactaagagccgaaattggcgtaagagaagctggggcaatgccgcaaatgttcggtactatcaccattagtgatgggatttctatgggaaccgaggggatgaaatattccctagtgtcacgagaagttattgctgattccattgaaaccgcctgtactggacaaagtatggatggcgttttggctattggtggctgtgataaaaatatgccaggggcaatgctagcgatggcgcgcatgaatattcctgctatttttgtttatggtggcacaattaaacccggtcactacgatggtaaagatttaaccgtcgtgagttcctttgaagcagttggtcaatacagcgccggtaaaattgatggtgatgaactcttagcagtggaacgtgaagcttgtcctggtgctggttcctgcggtgggatgtttacagcaaataccatgtcttccgcttttgaagcaatgggcatgagcttaccttattcttccacaatggcagccgaagatgctgaaaaagccgacagtacgcaaaaatcagcagttgctttagtagaagccatacgtaagcaaatcttacctcggcagattatcacccgtaaatctatagaaaatgccatttcagtaattatggcagtgggtggttccacaaatgcagtattgcactttttagcgatcgctcgtgcagctggagtagaactcacactagatgattttgaaaccatccgtggacgtgtcccagttatctgtgatttaaaacccagtggtaaatatgtcgccacagacctgcacaaagctggcggaatacctcaagtcatgaaaatgttacttgtgcatgatttactccacggcgactgcttaactatcacaggtaaaacagtagcagaagtcttagcagatatctccgcagaaccacgtaccgaccaagatgtgattcgtccttggaataaccccatgtatgctcaaggacacttagccatcctcaaaggcaacctagccacagaaggggctgtagccaaaatcaccggagttaaaaagccgattattactggccctgcacgggtatttgagtctgaggaatcctgtttagatgccatcctcgcaaataaaattaatgccggggatgttctcataattcgttacgaaggtcccaagggtggccctggtatgagagaaatgcttgctcccacctcagcaattattggggctgggttaggcgatgcagtaggtttaattactgatgggcgcttttccggcggtacttacggcatggtagttggtcacgtagccccagaagcagccgttggtggtgcgatcgctcttgtagaagaaggtgatagcattaccattgatgcctctaatcgcctcttgcaattgaacgtctcagatgaagaattagcccgtagacgtgccaattggcaaccccttccaccccgttacaccaaaggcgtacttgctaaatatgccaaattagtatcttctagcagtgttggagcagtcacagatttagacttatttaatggttag

SEQ ID NO: 286 - protein, 568 aa, Nodularia spumigena
MEGKKMSENLRSQVVTQGVQRSPNRAMLRAVGFKDEDFNKAIVGIANGYSTITPCNMGINKLALRAEIGVREAGAMPQMFGTITISDGISMGTEGMKYSLVSREVIADSIETACTGQSMDGVLAIGGCDKNMPGAMLAMARMNIPAIFVYGGTIKPGHYDGKDLTVVSSFEAVGQYSAGKIDGDELLAVEREACPGAGSCGGMFTANTMSSAFEAMGMSLPYSSTMAAEDAEKADSTQKSAVALVEAIRKQILPRQIITRKSIENAISVIMAVGGSTNAVLHFLAIARAAGVELTLDDFETIRGRVPVICDLKPSGKYVATDLHKAGGIPQVMKMLLVHDLLHGDCLTITGKTVAEVLADISAEPRTDQDVIRPWNNPMYAQGHLAILKGNLATEGAVAKITGVKKPIITGPARVFESEESCLDAILANKINAGDVLIIRYEGPKGGPGMREMLAPTSAIIGAGLGDAVGLITDGRFSGGTYGMVVGHVAPEAAVGGAIALVEEGDSITIDASNRLLQLNVSDEELARRRANWQPLPPRYTKGVLAKYAKLVSSSSVGAVTDLDLFNG

SEQ ID NO: 287 - DNA, 1701 bp, Nostoc punctiforme
atgtcggagaatttgagaagccaagtagtgacgcaaggagtgcagcgatcgccaaatcgagctatgctgcgggcagttggttttaaagatgaagatttcaataaagccattgtcggtatagccaacggttacagcacgatcaccccctgcaatatggggataaatcaactggcacagagggcagaagctgggattaaaaccgccggagcaatgccgcaaatatttggcacaattaccatcagcgacgggatttcaatgggaaccgaagggatgaaatattccctagtatcgcgggaagttatcgccgattccatcgaaaccgcctgtaccggacaaagtatggatggtgtactagccattggtggctgtgataagaatatgccaggcgcaatgctagcgatcgcgcggatgaatatcccggcaatattcgtttacggtggcacaattaaacccggtcactacaacggacgcgatttaaccgttgtcagttcttttgaagctgttggtcaatacagtgcgggaaaaattgacgacaaggaattattagaagtcgaaagtcgcgcttgtcctggcgctggttcctgcgggggaatgttcacagctaacaccatgtcttcagcatttgaagcgatgggaatgagtttaccctattcttccacaatggcagccgaagatgccgaaaaagccgacagcacggaaaaatcagcctttgtgctagtcgaagccatcaagaagcaaatcttaccccggcaaattatcacccgtaaatctatagagaatgccatctctgtgattatggcggtgggtggttcgaccaatgcagtattgcatttcttagcgatcgcccgcgctgcgaatgtagagttaaccctagatgactttgaaacaatccgcgcccgtgttcccgttttgtgcgatctaaaaccaagcggtaaatatgtcgctacagatttgcacaaagctggtggcattccgcaagtcatgaagatgctactcgcacatggcttattgcatggtgatagtctcaccattagcggtcaaaccattgcagagatattagcagacatacccgaagagccatctgccaatcaagatgtgattcgggcttggaataacccgatgtatgctcaaggacatttagccatcctcagaggtaatctggcaacggaaggggctgtcgctaaaattaccggcgtgaaaaaaccagtcattaccgggcctgcacgggtgtttgagtcggaagaagcctctttagatgcaattttggcgggtaaaattcaagctggtgatattttggttattcgctacgaagggcccaaaggcggccctggaatgcgagaaatgttggctcccacttcggcaattatcggggctggcttgggtgatgcggtgggattaattaccgatgggcgcttttctggcggtacttatggcatggtggttggtcatgttgctccagaagcagcagtgggtggtgcgatcgcgcttgttgaagaaggcgatagtattaccattgatgcacccgcacgccttttgcagttgaatatatctgaagaagaattagctcgtcgtcgtgctaattggcaacctcccgctccacgttacaccaaaggcgtgttggcgaaatatgccaaactggtatcttctagcagcatcggtgctgtgacagatttggatttgttcaaaccacaacagaactaa

SEQ ID NO: 288 - protein, 566 aa, Nostoc punctiforme
MSENLRSQVVTQGVQRSPNRAMLRAVGFKDEDFNKAIVGIANGYSTITPCNMGINQLAQRAEAGIKTAGAMPQIFGTITISDGISMGTEGMKYSLVSREVIADSIETACTGQSMDGVLAIGGCDKNMPGAMLAIARMNIPAIFVYGGTIKPGHYNGRDLTVVSSFEAVGQYSAGKIDDKELLEVESRACPGAGSCGGMFTANTMSSAFEAMGMSLPYSSTMAAEDAEKADSTEKSAFVLVEAIKKQILPRQIITRKSIENAISVIMAVGGSTNAVLHFLAIARAANVELTLDDFETIRARVPVLCDLKPSGKYVATDLHKAGGIPQVMKMLLAHGLLHGDSLTISGQTIAEILADIPEEPSANQDVIRAWNNPMYAQGHLAILRGNLATEGAVAKITGVKKPVITGPARVFESEEASLDAILAGKIQAGDILVIRYEGPKGGPGMREMLAPTSAIIGAGLGDAVGLITDGRFSGGTYGMVVGHVAPEAAVGGAIALVEEGDSITIDAPARLLQLNISEEELARRRANWQPPAPRYTKGVLAKYAKLVSSSSIGAVTDLDLFKPQQN

SEQ ID NO: 289 - DNA, 1692 bp, Nostoc sp.
atgtcggagaattttagaagcaaggctatcacacaaggggtacagcgatcgcctaacagagcaatgctgcgggctgttggttttcaggatgcagattttaccaaagccattgtaggtgttgccaatggttacagcacgattaccccgtgtaatatggggataaatcaactagcacaaagggcagaagctggtataaatactgctggagcaaagccgcaaatattcggtacaattacgattagtgatgggatttcgatgggaaccgaagggatgaaatattccctggtatcacgagaagtaatcgctgactccattgaaaccgtttgtaatgggcaaagtttagacggggtaattgccattggtggctgtgataagaatatgccaggggcaatgattgcgatcgcccggataaatatccctgctatctttgtttacggtggcacaattaaacccggacattacaacggtaaagatttaactgttgtcagttcttttgaggctgttggtgagtacagcgccggtaaaattgacgaaaatgaactgttagcagtagaacgcaatgcttgtcctggtgcaggttcctgcggtgggatgtacacagcaaataccatgtcctctgcttttgaagcactggggatgagtttgccctattcgtctacaatggcggcagaagatgacgaaaaagctgatagtacggaagaatcagccaaggtattggtagaggcgattcgtcatcaattattacccagacagattatcactcgtaagtccatagaaaacgccatatctgtaattatggctgtgggtggttctactaatgcggtgttacattttctagcgatcgcccgtgcggctggtgtagaactaaatctggacgactttgaaactattcgtggtcgtgtccccgttttgtgcgacttgaaaccaagcggtagatatgtggctacagacctgcacaaagctggtggtataccccaagtcatgaaaatgttactcgtgcatggtttactccacggcgactgtatgaccatcacaggtaaaaccattgccgaagttttagcagatatcccagaagaaccatcgcctaatcaagatgtaattcgtccttggaataaccccatgtatgcccaaggccacttggctatactcaaaggtaatttggcaacagaaggcgcagttgccaaaattactggtgtgaaaaatcctgtgattacagggccagccaaagtatttgaatcagaagaggattgtttagatgcaattttggcaggtaaaattaaagccggtgacgtgattgtcatccgctacgaaggccccaaaggcggccctgggatgcgagaaatgttagcccccacctcagctattatcggtgcaggtttaggcgactcagtgggactaattaccgatggacgcttctccggtggtacttacggtatggttgtgggacacgttgcaccagaagcagccgttggtggggcgatcgctctggtacaagaaggtgatagcatcacaattgatgcccacgcccgttctttgcagttgaacatatcagacgaagaattaacccgtcgtcgtgccaattggcaaccccgtcccccacgttacactacaggcatactggcaaaatacgccaagttggtagcttctagtagtgtgggtgctgtcaccgatttagacttattcaataaatag

SEQ ID NO: 290 - protein, 563 aa, Nostoc sp.
MSENFRSKAITQGVQRSPNRAMLRAVGFQDADFTKAIVGVANGYSTITPCNMGINQLAQRAEAGINTAGAKPQIFGTITISDGISMGTEGMKYSLVSREVIADSIETVCNGQSLDGVIAIGGCDKNMPGAMIAIARINIPAIFVYGGTIKPGHYNGKDLTVVSSFEAVGEYSAGKIDENELLAVERNACPGAGSCGGMYTANTMSSAFEALGMSLPYSSTMAAEDDEKADSTEESAKVLVEAIRHQLLPRQIITRKSIENAISVIMAVGGSTNAVLHFLAIARAAGVELNLDDFETIRGRVPVLCDLKPSGRYVATDLHKAGGIPQVMKMLLVHGLLHGDCMTITGKTIAEVLADIPEEPSPNQDVIRPWNNPMYAQGHLAILKGNLATEGAVAKITGVKNPVITGPAKVFESEEDCLDAILAGKIKAGDVIVIRYEGPKGGPGMREMLAPTSAIIGAGLGDSVGLITDGRFSGGTYGMVVGHVAPEAAVGGAIALVQEGDSITIDAHARSLQLNISDEELTRRRANWQPRPPRYTTGILAKYAKLVASSSVGAVTDLDLFNK

SEQ ID NO: 291 - DNA, 1686 bp, Trichodesmium erythraeum
atgccagagaatttgagaagtcaattagtcaccaaaggagtacaacgcgctcccaaccgagctatgctgagagctgtgggttttgaagattcagactttaccaaaccaattattggggttgccaatgcccatagcactattactccctgcaacatgggtattaatgatttggccatgagagctgtaagtggagtgaaagaagctggaggaatgccgcagatatttggaactattactattagcgatggaatttctatgggtactgaggggatgaaatattctctggtttctagagacgttattgctgattccatcgaaacagtttgtaatggccaaacaatggatggagttctagctattggtggatgcgataaaaatatgccaggagcaatgatagcgatcgctaggatgaatattcctgctatcttcgtatacggtggtactattaaaccaggcaactacaacggtaaagacctaacagttgtaagtgcttttgaagcagtgggagaatatagtgctggaaaaattgacgaaacagaattaacagaagttgaacgtagagcttgccctggtgctggttcctgtggaggaatgtttactgccaatactatgtcttcagcttttgaagcaatgggtatgagtctcatgtattcatcaacaatggctgcagaagatgcagaaaaagcagatagcacagaaaaatcagctcatgttttagtagaagctattcgcaaacaaattttacctagtcaaattattacccgtaaagctatcgaaaatgcaatttcagtaattatggctgtagggggttccactaatgcagtactacacctattagcaattgcttatgctgcaaatgtgaagttatctttagatgattttgaaataattagggccagagtacctgtattatgtgatttgaaacctagtggtaaatacgttacaacaaatttgcatcaagcgggtggaattcctttagtaatgaaaatgcttttagaacatgatttactccacccagatgctttaaccataacaggtaagactattggagagcaattaacaaatataccttctgaaccaccttctaatcaagacgtgattcgcccttggaataatcctatgtatgctcaaggacacttggctattttaaaaggaaatttggcgacagagggagcagttgctaaaattacaggagtgaagaacccagaaataacaggactagcaagagtatttgattcggaagaagcttgtttagaagcaatattagcagggaaaattcaagcagggaatattattgtagttcgctatgaaggtccaaaaggtggaccaggtatgcgagaaatgttagcaccaacttcggctattattggtgctggtttgggggataaagtgggattaattactgatggtaggttttctggtggtacttatggtatggtggttggtcatgtagctccagaagctgcagtaggtggcacgatcgctctagttaaggaaggagatatgattactattgatgctcataagcgtttactacagttaaatatttctgatgaggaattagaaaagcgtcgtcaagtatggaaaccacgaaaaccccaatatactagaggtgtattagctaaatatgctaagttagtttcttctagcagtgttggagcagtaactgacgctggattaggttga

SEQ ID NO: 292 - protein, 561 aa, Trichodesmium erythraeum
MPENLRSQLVTKGVQRAPNRAMLRAVGFEDSDFTKPIIGVANAHSTITPCNMGINDLAMRAVSGVKEAGGMPQIFGTITISDGISMGTEGMKYSLVSRDVIADSIETVCNGQTMDGVLAIGGCDKNMPGAMIAIARMNIPAIFVYGGTIKPGNYNGKDLTVVSAFEAVGEYSAGKIDETELTEVERRACPGAGSCGGMFTANTMSSAFEAMGMSLMYSSTMAAEDAEKADSTEKSAHVLVEAIRKQILPSQIITRKAIENAISVIMAVGGSTNAVLHLLAIAYAANVKLSLDDFEIIRARVPVLCDLKPSGKYVTTNLHQAGGIPLVMKMLLEHDLLHPDALTITGKTIGEQLTNIPSEPPSNQDVIRPWNNPMYAQGHLAILKGNLATEGAVAKITGVKNPEITGLARVFDSEEACLEAILAGKIQAGNIIVVRYEGPKGGPGMREMLAPTSAIIGAGLGDKVGLITDGRFSGGTYGMVVGHVAPEAAVGGTIALVKEGDMITIDAHKRLLQLNISDEELEKRRQVWKPRKPQYTRGVLAKYAKLVSSSSVGAVTDAGLG

SEQ ID NO: 293 - DNA, 1686 bp, Acaryochloris marin
atgtctgacaatcgaaatagccaagtcgtcactcaaggagttcaacgagcccccaaccgggccatgctaagggctgtgggctttggagatgatgattttaccaagccgattgttgggttagcgaatggttttagtacgattaccccttgtaatatgggcatagactctctggctacacgggcagaggccagtatcagaacggctggagccatgccgcaaaagtttggcaccatcactatcagtgacggcatttccatgggcacggaagggatgaaatattccttggtgtcccgggaagtgattgcagactccatcgagacggcctgtatgggccaaagtatggatggagtactcgccattggcggctgtgataaaaatatgccgggggctatgctcgccatggctcggatgaatattccggccatctttgtttacggcggcacgatcaaacccggacatctaaatggtgaagacttaaccgtggttagtgcctttgaagctgtgggtcagcatagtgctggacggattagtgaagccgagttaacggcagtggagaaacatgcttgtccgggtgctggatcctgtggcggtatgtatacggccaacaccatgtcttctgcgtttgaggcaatgggcatgagcctgatgtattcttccaccatggcagcggaagatgaagaaaaagccgtcagtgcagaacagtctgccgctgttttagtggaagcgatccacaagcaaattctgccccgcgatatcttgacccgcaaagcctttgaaaatgccattgctgtgattatggctgtaggcggatccaccaatgccgttctccacctgttggccatttcccgcgcggctggagactccctgaccctagatgacttcgaaaccatccgggctcaagttccagtgatctgcgatctcaaaccatcaggtcgctatgtagccacagatctccataaagcaggtggaatcccattggtgatgaaaatgctattggaacatggtcttctccatggtgatgctctgaccattacgggtaaaaccattgctgagcagttggctgatgtcccatcagagccttcccccgatcaggatgtaattcggccttgggacaatcccatgtataaacaaggccacctcgccatcctccggggtaacttggccacggaaggagcggttgccaaaatcacaggcattaaaaatccccaaattacgggtccagctcgggtatttgaatcggaagaggcttgcttggaggcgattttggcaggcaagattcagcctaatgatgtgattgtggtgcggtatgaaggcccgaagggtgggccgggaatgcgagagatgttagctcccacgtccgcgattattggggcaggtttgggtgattcagttggattgattacggatggtcgcttttctggtggaacttacggcatggtggttgggcatgtggccccagaagctgcggtgggtggtacgattgcccttgtgcaggaaggcgatcagattacaattgatgcccatgctcgaaagttggagctgcatgtgtctgatcaggagttaaaagagcggaaggagaagtgggagcaaccaaaacctctctataacaaaggggttttggcaaagtatgccaagttagtttcttctagtagtgttggagctgttactgatttagatctattttga

SEQ ID NO: 294 - protein, 561 aa, Acaryochloris marin
MSDNRNSQVVTQGVQRAPNRAMLRAVGFGDDDFTKPIVGLANGFSTITPCNMGIDSLATRAEASIRTAGAMPQKFGTITISDGISMGTEGMKYSLVSREVIADSIETACMGQSMDGVLAIGGCDKNMPGAMLAMARMNIPAIFVYGGTIKPGHLNGEDLTVVSAFEAVGQHSAGRISEAELTAVEKHACPGAGSCGGMYTANTMSSAFEAMGMSLMYSSTMAAEDEEKAVSAEQSAAVLVEAIHKQILPRDILTRKAFENAIAVIMAVGGSTNAVLHLLAISRAAGDSLTLDDFETIRAQVPVICDLKPSGRYVATDLHKAGGIPLVMKMLLEHGLLHGDALTITGKTIAEQLADVPSEPSPDQDVIRPWDNPMYKQGHLAILRGNLATEGAVAKITGIKNPQITGPARVFESEEACLEAILAGKIQPNDVIVVRYEGPKGGPGMREMLAPTSAIIGAGLGDSVGLITDGRFSGGTYGMVVGHVAPEAAVGGTIALVQEGDQITIDAHARKLELHVSDQELKERKEKWEQPKPLYNKGVLAKYAKLVSSSSVGAVTDLDLF

SEQ ID NO: 295 - DNA, 1683 bp, Lyngbya sp.
atgtcagataactttagaagtcaagccatcacccaaggaaagaaacgcacaccgaaccgggcgatgctccgagcggtagggtttggggatgaggactttaataagcctattgtcggcattgctaatggttacagtaccattactccctgcaacattggattgaacgatttggcgcatcgtgctgaaacggcattaaaacaagccgacgctatgcctcaaatgtttgggacgattactgttagtgatggcattgccatgggaaccgaggggatgaaatattctctggtttcccgagaggtgatcgccgatgcgattgaaactgcttgtaatgggcagagtatggatggcgttttggcgattggcggttgtgataaaaatatgcctggggcgatgattgcgatcgcgaggatgaatattccggcaatttttgtgtatggcggtacgattaaaccggggaatttaaacggttgtgatttaacggttgtcagtgcgtttgaggctgtcggcgaatacagcgccgggaaacttgatgatgatcgcttactcgatattgaacgccttgcttgtccgggttcggggtcttgtgggggaatgtttacggcaaatactatgtcttcggcgtttgaagcgatggggatgagtttaatgtattcttccacaatggcttctgaagatgcggaaaaggctgatagtaccgaaaagtctgcgtttgtgttgcgtgaggcgattagtcaacggattttaccgaagcaaattctcacccgcaaggcgtttgaaaatgcgatcgctgtgattatggcggtgggcggttcgacaaactcggtattacacttgttggcgattgcttatgcagcagatgtggaactgacgattgatgattttgaaacaattcggggacgggttccggttttatgtgatcttaaacccagtgggcgatttgtcacgacggattttcacaaagcgggtggcgttccgctgattatgaaaatgcttctcgaacagggtttaattcatggtgatgctttaacgattaccgggaaaacggttgccgaacagttggctgatattccctctcaaccgtctgcggatcaagaggtgattcgcccctggaataatccgatgtacaagcaagggcatttagcgattttgaagggaaatctcgccacagaaggcagtgttgctaaaattacaggcgtgaaaaaaccgcaaatgactggccccgcacgggtatttgagtcggaagaacagtgtttagaggcgattttagcgggtaaaattcaagctggagatgttttggtggttcgctatgaaggccccaaaggtggccccggaatgcgagaaatgttggcgccgacttccgcaattattggggcaggcttaggggattctgtgggcttgattaccgatggacggttttcggggggaacttatggcttggttgtcggtcatgttgccccagaagctgccgttggtggtaatattgcgttggttcaagagggcgatagtattacgattgatgcttcacaacggttattgcaggtgaatatttctgatcaggtattggaacaacgccgtcaaaattggcaaccgcctcaacctcgttacacaaaaggtgttttagctaaatatgcgaagttagtgtcttcgagtagtgtgggggcggtgacggatttagactgttaa

SEQ ID NO: 296 - protein, 560 aa, Lyngbya sp.
MSDNFRSQAITQGKKRTPNRAMLRAVGFGDEDFNKPIVGIANGYSTITPCNIGLNDLAHRAETALKQADAMPQMFGTITVSDGIAMGTEGMKYSLVSREVIADAIETACNGQSMDGVLAIGGCDKNMPGAMIAIARMNIPAIFVYGGTIKPGNLNGCDLTVVSAFEAVGEYSAGKLDDDRLLDIERLACPGSGSCGGMFTANTMSSAFEAMGMSLMYSSTMASEDAEKADSTEKSAFVLREAISQRILPKQILTRKAFENAIAVIMAVGGSTNSVLHLLAIAYAADVELTIDDFETIRGRVPVLCDLKPSGRFVTTDFHKAGGVPLIMKMLLEQGLIHGDALTITGKTVAEQLADIPSQPSADQEVIRPWNNPMYKQGHLAILKGNLATEGSVAKITGVKKPQMTGPARVFESEEQCLEAILAGKIQAGDVLVVRYEGPKGGPGMREMLAPTSAIIGAGLGDSVGLITDGRFSGGTYGLVVGHVAPEAAVGGNIALVQEGDSITIDASQRLLQVNISDQVLEQRRQNWQPPQPRYTKGVLAKYAKLVSSSSVGAVTDLDC

SEQ ID NO: 297 - DNA, 1686 bp, Synechocystis sp.
atgtccaacaatcccagaagccaggtaattacccagggcacccaacggagtcccaaccgggccatgctccgggccgttggttttggcgatgatgactttacgaaacccattgtgggtattgccaacgggtacagcaccattaccccctgcaacatgggcattaatgatctggctctacgggccgaggccggcttacggacagcgggggccatgccccaattgtttggcactatcaccatcagtgacggtatttccatgggtacggaagggatgaaatattccctagtttcccgggaagtgattgctgattccatcgaaacagtatgcaatggccaacgcatggacggagttttggcgatcgggggctgtgataagaatatgccgggggcaatgattgccatggctcgcctcaatattccctctatctttgtttacggtggcactattaaacccggacattatgccggggaagatttaacagtggtcagtgcctttgaagcggtgggccagtacagcgctggcaaaattgatgaggaaaccctctacggcattgaacggaatgcctgtcctggggctggttcctgtggggggatgttcaccgccaacaccatgtcctccgcctttgaagctatggggatgagcttgccctattcttctaccatggccgcagtggatggggaaaaagccgacagcaccgaggagtccgccaaggttttggtggaagccatcaaaaaacagattttgcccagtcaaattctgacccggaaagcttttgaaaatgccattgccgtgattatggccgtggggggctccactaatgcagtgctccatctgctggcgatcgccaacaccattggggtgcccctaagcttggacgattttgaaaccattcgccacaaagtacctgtactgtgcgacctcaaaccttccggcaaatacgtcaccactaatctccacgccgccggtggcattccccaggtgatgaaaatattgctggtcaatggcattctccacggtgacgctttaacgattacaggacagaccattgctgaagttttagccgatattcctgaccaaccccctgccggccaggacgtaatccattcctgggatgaccctgtttatcaagaaggtcacctggcagtgctcaaaggtaacctggccaccgaaggcagtgtggctaaaatcagcggtgttaaaaagccggtgatcactggtcccgccaaagtatttgaatctgaagaagattgcctagaagcgattctagccggcaaaattcaagcaggagatgtggtggtcgtgcgctatgaagggcccaaaggtggccccggtatgcgggaaatgctagcccccacttctgccatcattggggcagggttgggagactccgttggcctaatcaccgatggccgcttttctggtggtacctatggcttagtggtgggtcacgttgcccccgaagcttatgtgggaggggcgatcgccttggtgcaagagggggatcaaatcaccatcgatgctggcaagcggttactgcaactcaacatcagtgaagaggaattggcccaacggcgggcccaatggactcctcctcagccccgctatccccgggggattttagccaagtatgccaagttagtttcctccagcagccttggtgcagtgactgatatagacttgttctaa

SEQ ID NO: 298 - protein, 561 aa, Synechocystis sp.
MSNNPRSQVITQGTQRSPNRAMLRAVGFGDDDFTKPIVGIANGYSTITPCNMGINDLALRAEAGLRTAGAMPQLFGTITISDGISMGTEGMKYSLVSREVIADSIETVCNGQRMDGVLAIGGCDKNMPGAMIAMARLNIPSIFVYGGTIKPGHYAGEDLTVVSAFEAVGQYSAGKIDEETLYGIERNACPGAGSCGGMFTANTMSSAFEAMGMSLPYSSTMAAVDGEKADSTEESAKVLVEAIKKQILPSQILTRKAFENAIAVIMAVGGSTNAVLHLLAIANTIGVPLSLDDFETIRHKVPVLCDLKPSGKYVTTNLHAAGGIPQVMKILLVNGILHGDALTITGQTIAEVLADIPDQPPAGQDVIHSWDDPVYQEGHLAVLKGNLATEGSVAKISGVKKPVITGPAKVFESEEDCLEAILAGKIQAGDVVVVRYEGPKGGPGMREMLAPTSAIIGAGLGDSVGLITDGRFSGGTYGLVVGHVAPEAYVGGAIALVQEGDQITIDAGKRLLQLNISEEELAQRRAQWTPPQPRYPRGILAKYAKLVSSSSLGAVTDIDLF

SEQ ID NO: 299 - DNA, 1686 bp, Cyanothece sp.
atgtctgagaatgcaagaagtcgcctcattaccgagggaagtcaacgaacccctaaccgtgccatgttgcgtgctgtgggcttcggagatgatgattttaataagcctattgttggggtagctaatggcttcagtaccataaccccttgtaacatggggattaatgacctagctaaacgtgctgaagcaggaattaaaaccgctggtgggatgcctcagatattcggtaccattaccatcagtgatggcatttctatgggaaccgaaggcatgaaatattccctcgtctcacgggatgttattgccgactctatcgaaaccgtttgtaatggtcaaagcatggatggagtgatcgctattggtggatgcgacaagaatatgccaggggcaatgatagccatggcaagaatgaatatacctgcaatctttgtctatggaggaaccattaaacccggccattacaacggggaagatttaacagtagtcagtgcctttgaagcggtcggccaacatagtgcaggtaagatagatgatagcacattattggctattgaacgtaatgcttgccccggtgccggttcctgtgggggaatgttcaccgcaaataccatgtcttcagcgtttgaagtgatgggaatgagtttaccttattcttctacgatggcagcagaagatgcagaaaaagcagacagtacagaaaagtcagcttttgctttagttaatgccattcgtaaccagattttacccagtcacattttaacccgaaaagcctttgaaaatgccatttctgtaatcatggcggtgggaggttctacgaatgctgtattacaccttttagcgatcgctaataccatcggtgttgacctaactttagacgattttgaaaccattcgtcaacgggttcctgtactctgtgatttaaaaccatcgggacgctatgtaacggttaatttgcatgaagcgggtggcattcctcaagtgatgaaactattattaaatcatggattattacatggggatgcgttaacgatttccggtcaaactatagcagaaattttagccgatgtaccggatgaacctccagcgaatcaagatgttattcggacttgggataaccctgtttataaagagggacatttagccattttaaaaggtaatttagcctctgagggtgcagttgccaaaattagtggggtaaagaatcccaaaataacaggtccggcgcgagtttttgagtcggaagaggaatgtttagaggcaattttagcaggaaaaattaacgctggtgatgtcattattgtccgttatgaaggtcctagaggaggcccaggaatgcgagaaatgttagcaccaacttctgcaattattggggctggtttaggtgattccgtgggcttaattaccgatggccggttttctgggggaacctatggtttagtggtgggtcatgttgccccagaagcttacgtagggggtactattggcttagtaaaagaaggggatagtattaccattgatgctaaagaaaaactccttcaagtcaatgtttctgaagaagaattaaaccaacgtcgggctaattggaaagctcccgaacctcgttataaaagaggggtattaggtaagtatgccaagttagtttcttctagtagtttaggggcagttactgacgtgaatttgttttaa

SEQ ID NO: 300 - protein, 561 aa, Cyanothece sp.
MSENARSRLITEGSQRTPNRAMLRAVGFGDDDFNKPIVGVANGFSTITPCNMGINDLAKRAEAGIKTAGGMPQIFGTITISDGISMGTEGMKYSLVSRDVIADSIETVCNGQSMDGVIAIGGCDKNMPGAMIAMARMNIPAIFVYGGTIKPGHYNGEDLTVVSAFEAVGQHSAGKIDDSTLLAIERNACPGAGSCGGMFTANTMSSAFEVMGMSLPYSSTMAAEDAEKADSTEKSAFALVNAIRNQILPSHILTRKAFENAISVIMAVGGSTNAVLHLLAIANTIGVDLTLDDFETIRQRVPVLCDLKPSGRYVTVNLHEAGGIPQVMKLLLNHGLLHGDALTISGQTIAEILADVPDEPPANQDVIRTWDNPVYKEGHLAILKGNLASEGAVAKISGVKNPKITGPARVFESEEECLEAILAGKINAGDVIIVRYEGPRGGPGMREMLAPTSAIIGAGLGDSVGLITDGRFSGGTYGLVVGHVAPEAYVGGTIGLVKEGDSITIDAKEKLLQVNVSEEELNQRRANWKAPEPRYKRGVLGKYAKLVSSSSLGAVTDVNLF

SEQ ID NO: 301 - DNA, 1683 bp, Thermosynechococcus elongatus
atggcagaaaattggcgcagtcgcatcatcacagaaggcattcaacgcacccccaaccgagccatgctgcgagccgtgggttttggtgacgaggattttaacaagcccattgtgggggtggccagtgcccacagcacaattacgccctgcaacatggggattgctgcccttgccagtcgcgccgaagcaggaattcgggccgcgggagggatgccgcaattgtttggcaccattacggtcagcgatggtatttccatgggcactgaagggatgaaatactctttggtctcgcgggatgtgattgctgattcgattgagactgtctgtaatgcccagagtatggatggggtgctggcgatcggtggctgtgacaagaatatgcctggcgccatgattgccatggcacggatgaacattccagccatttttgtctatgggggtacgattaagcccggtcattggcaggggcaagaccttacggttgtcagcgcctttgaggccgtaggtcagtttagtgccggcaaaatggatgaggcaacgctccatgccattgaacaccatgcctgtccgggggcgggctcctgtggcgggatgttcacagccaatacgatgtcctcggcctttgaggccatgggcatgagtttaatgtattcctcaacgatgacggcggaagatgccgaaaaagctgacagcactgagttggcgggcaaggtgctggtggaggcaatccgcaaaaatattcgcccccgtgacattattacccgcaaatccattgaaaatgccatcagtgtgattatggctgtggggggatccacaaatgccgtgctgcattttctggcgatcgcccacagtgccgaggttcccttgaccattgatgattttgaaacgattcgccagcgggtgcccgttctctgcgacctcaagccctcgggtaaatacgtcactgcggatctacatcgggcagggggcattccccaagtcatgaaaatgctcctcaatgccggattgctccacggggattgcctaacgattactggagaaaccattgccgagcggctgcggcatgtgcccgatacccccgaccccaaccaagatgtgattcgtccttttgatcaacccttgtatgccacgggtcacctggctattctcaagggcaatctagccagcgaaggtgctgtagccaaaatctccggggtgaaaaatccccaaattaccgggcctgcccgcgtctttgactccgaggaagactgccttgacgccattctggcgggcaagatcaaccccggcgatgtcattgtcattcgctatgaaggccccgtcggcggtccggggatgcgggaaatgctggctcccacctctgccattattggtgcgggtttaggggatagtgttggcctcattaccgatggtcgcttttccggaggcacctatggcatggtcgtcggtcatgtggcgccggaagcggcagttggtgggacgatcgcccttgtgcaggagggagattcgattaccattgacgcccatcggcggctcctacaactgaatgtcagtgaggaagaactggcggcgcggcgggctaaatggcagccccctgcccctcgctacacccgtggtgtcttggctaaatatgccaaactagtgtcctctagtagtctgggagcggtgacggatcgctttgtctag

SEQ ID NO: 302 - protein, 560 aa, Thermosynechococcus elongatus
MAENWRSRIITEGIQRTPNRAMLRAVGFGDEDFNKPIVGVASAHSTITPCNMGIAALASRAEAGIRAAGGMPQLFGTITVSDGISMGTEGMKYSLVSRDVIADSIETVCNAQSMDGVLAIGGCDKNMPGAMIAMARMNIPAIFVYGGTIKPGHWQGQDLTVVSAFEAVGQFSAGKMDEATLHAIEHHACPGAGSCGGMFTANTMSSAFEAMGMSLMYSSTMTAEDAEKADSTELAGKVLVEAIRKNIRPRDIITRKSIENAISVIMAVGGSTNAVLHFLAIAHSAEVPLTIDDFETIRQRVPVLCDLKPSGKYVTADLHRAGGIPQVMKMLLNAGLLHGDCLTITGETIAERLRHVPDTPDPNQDVIRPFDQPLYATGHLAILKGNLASEGAVAKISGVKNPQITGPARVFDSEEDCLDAILAGKINPGDVIVIRYEGPVGGPGMREMLAPTSAIIGAGLGDSVGLITDGRFSGGTYGMVVGHVAPEAAVGGTIALVQEGDSITIDAHRRLLQLNVSEEELAARRAKWQPPAPRYTRGVLAKYAKLVSSSSLGAVTDRFV

SEQ ID NO: 303 - DNA, 1698 bp, Synechococcus sp.
atggccaattcccctttcccgctgcgcagccaagtggttacccagggagtacagcgctcccccaaccgcgccatgctcagggccgtaggctttcgcgacgaagacttcggcaagcccattgtcggcattgccaacgcccacagcaccctcaccccctgcaacatggggatccaaactctggcggagcgggcggaggcggctttgagaacggcgggctgtatgccccaggtgttcggcaccatcaccattagcgacggcatctcgatgggcacggaggggatgaaatactccctggtgtcgcgggaagtgattgccgattccatcgagacggtggtcaacggccagagcatggatggcctcttggccattggcggctgcgacaagaacatgccgggggcgatgatcgccatggcccgcctcaatgtgccctccatcttcgtctacggcggcaccatcaagccgggtcactacaatggccgcgacctcaccatcgtcagcgcctttgaagcggtgggggagttcagtgccgggcgcatctccgaggaagagctgctggcggtggagcgccatgcctgtcccggtgccggatcctgcggcggcatgtacacggccaacaccatgtccagcgcgtttgaggctatggggatgagtctgccctactcctccaccatggctgcagaagacgaagagaaagccgaaagtgccgcccaatcggccaaggtcttggcagaggccatcaaagccaacatccgcccccgcgacatcatcacccgtaaaagcattgaaaatgccatctcggtgatcatggccgtagggggatccaccaacgccgtgctccactttctggccattgcccatgcggcagaagtgcccctgacgctagatgatttcgagaccattcgtgctcgcgtgcctgtcctctgcgatctcaagccttcagggcggtttgtggccaccgacctgcaccgggccggtgggatcccccaggtgatgaaaatgctgctcaaccacggcctgctgcacggggactgcctcaccatctccggccagaccatcgtcgaagtcctgcgggatgtgccggacgagcctagcccggatcaggaggtgatccgcccttggcacagccccctgtatccccaagggcatctggccatcctcaaggggaatctggctcccgaaggagcagtagccaagattaccggcgtcaagaacccgcaaattaccgggccggcgcgggtcttcgattcagaggagtcctgcctgcaggccatcctctccggccagatccgagcaggggatgtggtggtgatccgctacgaaggccccaaaggtggccccggcatgcgggagatgctctcgcccacttcggccatcatcggcgccggcttgggggatagcgttggcctgatcaccgatggccgcttctccggcggcacctacggcatggtagtgggccatgtggctcccgaagcctatgtggggggcacgattgccctggtggaggaaggggatctcatcaccattgatgccccggctcgccagttgcacttgcatgtgagcgaagaagagctggcccgccgccgcgcccgctggtctcctcctgagcctcgctacaaacggggcaccctagccaagtacgccaagctggtctccagcagcagcctgggggcagtgacggatttaaacctgtgggattaa

SEQ ID NO: 304 - protein, 565 aa, Synechococcus sp.
MANSPFPLRSQVVTQGVQRSPNRAMLRAVGFRDEDFGKPIVGIANAHSTLTPCNMGIQTLAERAEAALRTAGCMPQVFGTITISDGISMGTEGMKYSLVSREVIADSIETVVNGQSMDGLLAIGGCDKNMPGAMIAMARLNVPSIFVYGGTIKPGHYNGRDLTIVSAFEAVGEFSAGRISEEELLAVERHACPGAGSCGGMYTANTMSSAFEAMGMSLPYSSTMAAEDEEKAESAAQSAKVLAEAIKANIRPRDIITRKSIENAISVIMAVGGSTNAVLHFLAIAHAAEVPLTLDDFETIRARVPVLCDLKPSGRFVATDLHRAGGIPQVMKMLLNHGLLHGDCLTISGQTIVEVLRDVPDEPSPDQEVIRPWHSPLYPQGHLAILKGNLAPEGAVAKITGVKNPQITGPARVFDSEESCLQAILSGQIRAGDVVVIRYEGPKGGPGMREMLSPTSAIIGAGLGDSVGLITDGRFSGGTYGMVVGHVAPEAYVGGTIALVEEGDLITIDAPARQLHLHVSEEELARRRARWSPPEPRYKRGTLAKYAKLVSSSSLGAVTDLNLWD

SEQ ID NO: 305 - DNA, 1683 bp, Gloeobacter violaceus
atgtccggcaatctgcgcagccgcatcgtcacccagggggtgcagcgctcccccaaccgcgccatgctgcgggcggtgggttttggcgacggtgatttcgagcggcccatcgtgggggtggccaacggcttcagcacgattaccccctgcaatctgggcctgggagctttggcggagcgggcggaggcggcgttgcgcgccggcggggcgatgccccaactattcggaacgatcacgatcagcgacggcatctcgatgggtaccgaggggatgaagtactcgctggtgtcccgcgaggtgatcgccgacagcatcgagacggtctgcaacggtcagagcctggacggggtgctcgctatcggcggctgcgacaagaacatgccgggtgcgatgatcgccattgccagactcaatatcccggcggtcttcgtctacggcggcacgatcaaacccggccgctaccaggatcaggacctcacggtcgtgagcgccttcgaagcggtgggccagtacagcgccggcaaaattgaccagacgaccctcgtcgaaatcgagcggcgcgcctgcccgggggcgggctcctgcggcggcatgtacaccgccaatacgatgagttcggccttcgaggcgatgggcatgagcttggtgtactcctcgacgatggccgccgaggatcccgaaaaagcggacagcaccgccctgtcggccaaggtgctggttgaagcgatccaagcgcaaatcctgccgagcgccatcctgacgcgaaaagctttcgagaacgccatcgctgtgatcatggccatcggcggctcgaccaacgccgtgctgcacctgcttgccatcgcccacagcgcccgggtgccactcgcactggatgacttcgagtgcatccgcgcgcgggtgccggtgctgtgcgatctcaagcccagcggtcgctttgtcgccaccgatctgcacagagccgggggtattccccaggtgatgaaaatgttgctcgtgcgcgggctcctccacggcgacgccctcacggtaaccggccagacggtcgccgaggtgctgcgcgacgtacccacagaaccgcgcaccgaccaggaggtgatccgtccctgggaccggcctctctacagttcggggcacctggccattttgcgcggcaacctggcgagcgaaggggcggtcgccaagattaccggcgtcaaaaagccccagatcactggtcctgcccgcgtcttcgactccgaagaaagctgcatggaagcaattctggcgggcgccatccagccgggcgatgtgatcgtcattcgctacgaaggccccaagggcggtcccggcatgcgggagatgctctcgcccacttcggccatcatcggcgcgggtctgggcgatgcggtgggactgatcaccgacggccgcttctcggggggcacctacggcatggtcgtgggccacgtcgccccggaagccttcgtgggcggcaccatcgccctggtcgaagcaggagatctgatcaccatcgacgccccggcgcgcaagatcgagctattggtgaccacagacgaactggagcgccgacgcgccgcctggcggccgcctgccccccgttacatccgcggggtgctcgccaagtacgcccgtcaggtgaacagcagcagcctcggggcggtcaccgacgcctttatttga

SEQ ID NO: 306 - protein, 560 aa, Gloeobacter violaceus
MSGNLRSRIVTQGVQRSPNRAMLRAVGFGDGDFERPIVGVANGFSTITPCNLGLGALAERAEAALRAGGAMPQLFGTITISDGISMGTEGMKYSLVSREVIADSIETVCNGQSLDGVLAIGGCDKNMPGAMIAIARLNIPAVFVYGGTIKPGRYQDQDLTVVSAFEAVGQYSAGKIDQTTLVEIERRACPGAGSCGGMYTANTMSSAFEAMGMSLVYSSTMAAEDPEKADSTALSAKVLVEAIQAQILPSAILTRKAFENAIAVIMAIGGSTNAVLHLLAIAHSARVPLALDDFECIRARVPVLCDLKPSGRFVATDLHRAGGIPQVMKMLLVRGLLHGDALTVTGQTVAEVLRDVPTEPRTDQEVIRPWDRPLYSSGHLAILRGNLASEGAVAKITGVKKPQITGPARVFDSEESCMEAILAGAIQPGDVIVIRYEGPKGGPGMREMLSPTSAIIGAGLGDAVGLITDGRFSGGTYGMVVGHVAPEAFVGGTIALVEAGDLITIDAPARKIELLVTTDELERRRAAWRPPAPRYIRGVLAKYARQVNSSSLGAVTDAFI

SEQ ID NO: 307 - DNA, 1674 bp, Nitrosomonas eutropha
atgccagacaatcgacgcagccaggccatcactaaaggtgcgaaacgtgctcccaatcgcgccatgttacgtgcagttggattcggtgacggagatttcgataagcccattgtcggcattgccaacggcttttccaccatcacgccttgcaacatggggctggatacgcttgccaaatgtgcggaacatgcattgaaaaatgccggtgccatgccgcaaatgttcggcacgattacggtatcggatggtatctccatgggcaccgaaggcatgaaatactcactggtatcacgcgaggtaatcgctgattccattgaaacctgcgtgcaggcggaaagcatggatggcgtcattgccattggcgggtgtgacaaaaacatgcctggtgccctaatcgcgctggctagactgaacgtgccatccatttttgtctatggcggcaccatcaagcccggtcactaccagggtcgcgatctgacaatcgtcagtgcgtttgaagcggttgggcaacatagcgcacacaagattgatgatcaggaactgctggaagttgaacgccatgcctgtcccggcgcaggttcgtgcggcggcatgtacaccgccaacaccatgtcctctgcgattgaggcgatgggcatgagtctgccccattcctccactatggctgcggaagatgaggaaaagcggatcagcgccacccgctctgccgaggtgctggtggaagcaatcaaaaaacagattctgccgcgcagcctgattacccgcaagtcactcgaaaatgcagtaacggtagtcatggccgtaggcggctcgaccaatgctgtgctgcatctgctggccatcgcccacgcagcagaagtagattttcatattgacgatttcgaagcgattcgtgcccgtgtgccggtgttgtgtgacctgaaaccttccgggcgctacgtcgccactgatctgcacagagcaggcggcattccacaagtgatgaaaatgctgctcgtgcacggtctgctgcatggtgactgtctgaccatcagcggacaaactatcgctgaagtactgaaagatattcctgaacaaccgcgcgcggatcaaaacgtcatccgcacctgggacaacccggtgtatgaacaaggtcatctggcgatcctgaagggtaatctttcgccggaaggtgcggtggccaagatttccggtgtaaaaaaccccaatattaccgggcccgccagagtgtttgaatccgaagaaacctgtatgactgccattctcgatcgcaaaatcaagccgggtgatgttgtcgttattcgctacgaggggccacgcggcggtcccggcatgcgtgaaatgctctcccctacttcggcgctaatcggtgaaggattgggtgattcggtcggattgattaccgatggccgtttttccggcggcacctacggcatggtcgtaggccatgtagcaccggaagcatacgccgggggagtgatcgctctggtggaagaaggagattcaatcacaatcgatgcgcatcgccgcctgttacaactgaatgtttcagaaacagaattggaacgccgccgggctgcctggcagccgcctgcgccgcgctacacacgcggtgtactggcaaaatatgccaaactggtatcaaccgccagtcgtggtgcggttactgattaa

SEQ ID NO: 308 - protein, 557 aa, Nitrosomonas eutropha
MPDNRRSQAITKGAKRAPNRAMLRAVGFGDGDFDKPIVGIANGFSTITPCNMGLDTLAKCAEHALKNAGAMPQMFGTITVSDGISMGTEGMKYSLVSREVIADSIETCVQAESMDGVIAIGGCDKNMPGALIALARLNVPSIFVYGGTIKPGHYQGRDLTIVSAFEAVGQHSAHKIDDQELLEVERHACPGAGSCGGMYTANTMSSAIEAMGMSLPHSSTMAAEDEEKRISATRSAEVLVEAIKKQILPRSLITRKSLENAVTVVMAVGGSTNAVLHLLAIAHAAEVDFHIDDFEAIRARVPVLCDLKPSGRYVATDLHRAGGIPQVMKMLLVHGLLHGDCLTISGQTIAEVLKDIPEQPRADQNVIRTWDNPVYEQGHLAILKGNLSPEGAVAKISGVKNPNITGPARVFESEETCMTAILDRKIKPGDVVVIRYEGPRGGPGMREMLSPTSALIGEGLGDSVGLITDGRFSGGTYGMVVGHVAPEAYAGGVIALVEEGDSITIDAHRRLLQLNVSETELERRRAAWQPPAPRYTRGVLAKYAKLVSTASRGAVTD

SEQ ID NO: 309 - DNA, 1674 bp, Nitrosomonas europaea
atgccagataatcgacgcagccaaaccattacccaaggtgcacaacgcacccccaaccgcgccatgttacgcgcagtcggtttcggtgacggagacttcgataaacctatcgtcggggttgccaacggtttttccaccatcacaccctgcaacatggggctggatacccttgccaaatgcgccgaacatgcgctgaaaaccgccggtgccatgccgcagatgtttggcaccatcaccgtatccgacgggatctccatgggtaccgaaggcatgaagtattctctggtttcgcgcgaagtgatcgccgattcgatcgaaacctgcgtacaggcggaaagtatggatggcgtcatcgccatcggtggttgcgataaaaacatgcctggcgccatgatcgcgctggccagactgaacgtaccgtccatcttcgtctatggcggtaccatcaaacctggccattaccagggccgtgatctgaccatcgtaagcgctttcgaagctgtcggacagcataccgcgcacaagatagacgatcatgaactgctggaagtcgaacgccatgcctgtcccggcgccggttcgtgcggtggtatgtacacagccaacaccatgtcatctgccatcgaggcaatgggaatgagcctgccttactcttccaccatggcagcagaagatgaggaaaaacggatcagcgccatacgctccgccgaagtactggtggacgcggtcaaaaagcagattctgccgcgcagcctgatcacccgcaaatccatcgaaaatgcggtatctgtcgtcatggcggtgggaggttcgaccaatgccgtgctgcacctgctggccatcgcccatgcagccgaagtggaattcagcatcgatgatttcgaagccattcgtgcacgcgtaccggtattgtgcgatctgaaaccttccggacgctatgtagccacggatctgcacaaagcgggcggtattccgcaagtgatgaaaatgttgctggtacacgacctgctgcacggcgactgtctgaccatcagcggacaaaccatcgcggaagtgctgaaagacattcccgaacagccgcgtgccgatcaggatgtgattcaaccctgggacaatccggtatatgaacaggggcacctggcgatcctgaaaggtaatctttcatcagaaggtgcggttgccaagatttccggcatcaaaaatcccagtattaccggtcccgccagagtgttcgattctgaagaaacctgcatggctgccattcttgaacgcaaaatccagccaggtgatgtggtggtcatccgctacgaaggcccacagggcggacccggcatgcgcgaaatgctttctcccacttcagcactgatcggtgaagggctgggtgattcggtcgggttgattaccgatgggcgtttctccggtggtacctacggaatggtggtgggccatgtggcaccggaagcattcgccggcggaacgatcgccctggtacaagagggagattcgattacgatcgatgcacaccgtcgcctgctgcaactgaatgttcctgaagccgagctggaacgccgccgggcagcctggcatccacctgcaccacgctacacacgcggcgtactggcgaaatacgccaagctggtatccactgccagccgtggtgcagtcaccgattaa

SEQ ID NO: 310 - protein, 557 aa, Nitrosomonas europaea
MPDNRRSQTITQGAQRTPNRAMLRAVGFGDGDFDKPIVGVANGFSTITPCNMGLDTLAKCAEHALKTAGAMPQMFGTITVSDGISMGTEGMKYSLVSREVIADSIETCVQAESMDGVIAIGGCDKNMPGAMIALARLNVPSIFVYGGTIKPGHYQGRDLTIVSAFEAVGQHTAHKIDDHELLEVERHACPGAGSCGGMYTANTMSSAIEAMGMSLPYSSTMAAEDEEKRISAIRSAEVLVDAVKKQILPRSLITRKSIENAVSVVMAVGGSTNAVLHLLAIAHAAEVEFSIDDFEAIRARVPVLCDLKPSGRYVATDLHKAGGIPQVMKMLLVHDLLHGDCLTISGQTIAEVLKDIPEQPRADQDVIQPWDNPVYEQGHLAILKGNLSSEGAVAKISGIKNPSITGPARVFDSEETCMAAILERKIQPGDVVVIRYEGPQGGPGMREMLSPTSALIGEGLGDSVGLITDGRFSGGTYGMVVGHVAPEAFAGGTIALVQEGDSITIDAHRRLLQLNVPEAELERRRAAWHPPAPRYTRGVLAKYAKLVSTASRGAVTD

SEQ ID NO: 311 - DNA, 1674 bp, Nitrosospira multiformis
atgtcagataaccagcgcagccgggcaatcacccagggggcggaacgtacccccaaccgcgcgatgctgcgggccgtaggtttcagcgacaacgatttcgacaaaccaatcgtcggcgtggccaatggcttttccaccatcacaccctgcaacaagggattgaacgaactggcgctggctgccgagcaggcattgaaacaggcggctgcgatgccccagatgttcggtaccatcaccgtttccgatggcatctccatgggaacggagggcatgaagtattcactggtatcccgcgaagtcattgccgactcgatcgaaacggcggtgcaggccgaaagcatggatggcgtgatcgccatcgggggctgtgacaagaacatgccaggagcaatgatcgccattgcgcgcatgaatgttcccgcaatttttgtttatggcggaacgattaaaccgggccactataaaggaaaggatctcactattgtcagcgcattcgaagccgtcggacaatatacctcccacaagatagacgcgaaagaactgctcgaagtggagcgccacgcctgtccgggagccggctcctgcggaggcatgttcactgccaatacgatgtcgtccgctttcgaagcgatgggcatgagtctcccctattcttccacgatggccgcggaggatggcgagaagctaaccagcgcggcgcgctccgcggaagtgctcgtggatgccatcaggaaacagattcgcccgcgcgacatcattacccgcaagtccattgaaaacgcgatcgcggtgatcatggccgtgggtggttccaccaatgctgttttgcacttcctcgccattgcccatgcggccgaagtgacactcaccatcgatgattttgaacgcatgcgcggcaaagtgccggtactgtgcgatctcaaaccttcgggacggtacgttgccaccgacctgcacaaggcagggggcattccccaggtcatgaaaatgctgctcgaccacggcctgttgcatggcgactgcatcaccatcagcggacagaccattgccgagatattgaaggatgtgccgtcagagcctcgcgaagatcaggatgtcattcgccagtgggacaacccgttgtacgtccagggccacctcgccatactcaagggcaatctcgccccagaagggtgcgtggcgaaaatcaccggggtgaaatccccaaaaattaccggaccggcacgcgtattcgattcggaagaagcctgcatggcagctatccttgcgcgggagatccagcccggcgacgtggtggtgatacgctatgagggacccaagggcggccccggcatgcgggaaatgctgtctcccacttccgcgcttattggcgagggactcggagattcggtgggcctgatcaccgatggacgattctccgggggcacctatggaatggtggttggacacgtggcgccggaggcgttcgtaggcgggaccattgcgctggtgcgagaaggcgattcgattaccatagacgccgagcaacggctgctgcagctcaacattcccggagatgagctggctcggcgccgggctgaatggcaaccgccccatccgcgctacacccggggagtgctcgctaaatattcgaagctcgtctcgagtgccagccgcggcgcaatcaccgactag

SEQ ID NO: 312 - protein, 557 aa, Nitrosospira multiformis
MSDNQRSRAITQGAERTPNRAMLRAVGFSDNDFDKPIVGVANGFSTITPCNKGLNELALAAEQALKQAAAMPQMFGTITVSDGISMGTEGMKYSLVSREVIADSIETAVQAESMDGVIAIGGCDKNMPGAMIAIARMNVPAIFVYGGTIKPGHYKGKDLTIVSAFEAVGQYTSHKIDAKELLEVERHACPGAGSCGGMFTANTMSSAFEAMGMSLPYSSTMAAEDGEKLTSAARSAEVLVDAIRKQIRPRDIITRKSIENAIAVIMAVGGSTNAVLHFLAIAHAAEVTLTIDDFERMRGKVPVLCDLKPSGRYVATDLHKAGGIPQVMKMLLDHGLLHGDCITISGQTIAEILKDVPSEPREDQDVIRQWDNPLYVQGHLAILKGNLAPEGCVAKITGVKSPKITGPARVFDSEEACMAAILAREIQPGDVVVIRYEGPKGGPGMREMLSPTSALIGEGLGDSVGLITDGRFSGGTYGMVVGHVAPEAFVGGTIALVREGDSITIDAEQRLLQLNIPGDELARRRAEWQPPHPRYTRGVLAKYSKLVSSASRGAITD

SEQ ID NO: 313 - DNA, 1695 bp, Chloroflexus aggregans
atgagcgataatcgccgtagtcgtatgattaccgaaggcccacagcgttcacccaatcgggcaatgctgcgcgcggtcgggtttggcgacaacgattttacgaagccgatcgtgggagtggctaacggtcacagtacgctgacaccgtgcaacgccggcttaggggcgttggcagcgcgggcggaagccgctattcgtgccgcaggaggtatgccgcagatcttcggcacgatcacggtcagcgatggtatctcgatggggactgaagggatgaagtattctttggtcagccgcgaggtgattgccgattcgattgagacggtcgtcaacgcacagcggatggacggaatccttgcggtgggtggctgcgataagaacatgcccggcgccttaattgccatggcccggctcgacattccggccatctttgtctatggtggtactatcaaacccggtcattacaaaggccgtgacttgaccatcgtcagcgtgtttgaggcagttggcgaatacagtgccggtcggatcgacgaacacgagttgctcgaaatcgagcgtcacgcatgccccggcgtcggttcgtgtggtggtatgtacactgccaatacgatgtcgtcggcaattgaagcgctgggcttgagtttacccggctcttcaaccatggctgccgaagacgaggaaaaggcgatcagcgcagctcgttccggcgaggtgttagttgaggccatccgcgccaatcgcacagcgcgccagatgttgacccgcaagtcgtttgagaatgcgattgcagtagtgatggcgttaggtggctcgaccaacgccgttttgcatctgctggcgattgcctatgctgccaacgtaccgttgaccatcgatgattttgagacgatccgccagcgggtaccggtgctctgcgatctcaagccatcgggccgctatgtggcgaccgatctccaccgtgtcggtggtgtaccgcaggtgatgaagatgttgttgaatgccggcttactccacggtgattgtatgacgattaccggacagacaatcgctgaggtgctggccgatgtacccgacgagccgccggccgatcaagatgtcatccgcccctttcataaacccctctatccgcaaggacatttggccatcctccgtggtaatctggccgaagaaggctgcgttgcgaagattaccggtattaagcagcgctcgattaccggaccggcccgtgttttcgatgccgaagaggaatgtctcgaagcgattttgagtggcaagattaagccgggcgatgtcgtggtgatccggtacgaagggccgaagggtggtcccggtatgcgtgaaatgctcgctccgacatcggcgattatcggtgccggtttgggcgatagcgttggcctgattaccgacggacgcttctctggtggtacgtatggcttggtggtcggtcatgttgcccctgaagcggcggttggtggcaccattgccctggtcgaagagggtgatagtatcacgattgacgccgatgcccgtctcttgcagctcaatgtctcggacgaagagttggcacgacgccgtgctgcgtggcaaccccgtccgccacgctatacccgtggtgtattggcgaagtatgccaggctggtgtcgtcggctagccttggtgcagtgaccgaccgcttcgatggcgagtcggcgtaa

SEQ ID NO: 314 - protein, 564 aa, Chloroflexus aggregans
MSDNRRSRMITEGPQRSPNRAMLRAVGFGDNDFTKPIVGVANGHSTLTPCNAGLGALAARAEAAIRAAGGMPQIFGTITVSDGISMGTEGMKYSLVSREVIADSIETVVNAQRMDGILAVGGCDKNMPGALIAMARLDIPAIFVYGGTIKPGHYKGRDLTIVSVFEAVGEYSAGRIDEHELLEIERHACPGVGSCGGMYTANTMSSAIEALGLSLPGSSTMAAEDEEKAISAARSGEVLVEAIRANRTARQMLTRKSFENAIAVVMALGGSTNAVLHLLAIAYAANVPLTIDDFETIRQRVPVLCDLKPSGRYVATDLHRVGGVPQVMKMLLNAGLLHGDCMTITGQTIAEVLADVPDEPPADQDVIRPFHKPLYPQGHLAILRGNLAEEGCVAKITGIKQRSITGPARVFDAEEECLEAILSGKIKPGDVVVIRYEGPKGGPGMREMLAPTSAIIGAGLGDSVGLITDGRFSGGTYGLVVGHVAPEAAVGGTIALVEEGDSITIDADARLLQLNVSDEELARRRAAWQPRPPRYTRGVLAKYARLVSSASLGAVTDRFDGESA

SEQ ID NO: 315 - DNA, 1674 bp, Leptospirillum sp.
atgaaaaagccatttcgaagccggaccatcacccagggagtggaaagatctcccaacagggccatgctccgggccgtcgggttccaggatggggattttgaaaaaccgattatcggagtggcgaatggctacagcaccattacaccctgcaacatgggcctgaacagtctggctcttcgtgccgaggacgccattcgccagagaggagccatgccccagatgttcggaaccatcacggtttcggacggaatatcgatgggaacggaaggaatgaagttttccctggtgtcccgggaagtcatcgccgactccatcgaaacggcggtcagcgcccaaagcatggacggcgtgatcgccatcggggggtgcgacaagaacatgccgggagccctgatcgccatggggcgcatgaacatcccctccatttttgtttatggaggaaccatcaagcccggccactgggaaggtcaggacctgacggtcgtgagctcgttcgaagcggtcggggcctactcggcaggcaagatggacgaggcaaccctgaccgaaatcgagcgtcatgcctgtccgggagccggatcctgtggcggcatgttcactgccaataccatgtcgtcggcgatcgaagccatggggatgagtttgccctattcctccaccatggcagcggaagaccttgaaaaagccgaaagcgcagccgaatccgcaagagttcttgtccaggcggttctgaacgacctgcgtcctcgacagatcctgaccagaaaggcctttgaaaacgccattgcagtcctgatggccgttggaggctcgacgaacgcggttcttcacctcctcgcgatcgcccgctccgtcgacgtccccctttccatagacgactttgaacacattcgacgaaaggtccctgtcctttgcaacctcaagccctccggggcctatgtcgccacacagcttcacgctgtcgggggcattcccctcgtcatgcgcatgctgctggacaacggactccttcatggcgacgcgctgaccattacagggaagacgatttccgagacgctccgggacgttccttcccgtcccccggccggacaggatgtcgtgctcccctttgacaaacccgtttaccgggagggccaccttgcgatcctgaagggaaatctcgccccggaaggatcggtcgcaaagatctcgggcatcaaacaccgttccattaccggcccggcccgggtcttcgactccgaagaacgctgcatggcagccatcctggcccgggaaattcgtcccggagacatcgtcgtgatccggtacgaaggccccaaaggcggtcccggaatgcgggaaatgctggccccgacctccgccctgatcggagaaggtctcggggactcggtcggcctgattacagatggacgtttttccgggggcacatacggcatggtggtgggtcacgtctcgccggaagcggctgtgggcgggccgatcggactggtgcaggaaggagacctcattacgatcgacgccgaccggaatctgatcgaggtcaaggtttcaccggacgaaatgacaagaagaaaatctctgtggaaggaaccccctctccgatacacaaaaggaatcatggccaaataccgtcttctcgtcaaaagtgccagcgaaggcgccgtgacagactga

SEQ ID NO: 316 - protein, 557 aa, Leptospirillum sp.
MKKPFRSRTITQGVERSPNRAMLRAVGFQDGDFEKPIIGVANGYSTITPCNMGLNSLALRAEDAIRQRGAMPQMFGTITVSDGISMGTEGMKFSLVSREVIADSIETAVSAQSMDGVIAIGGCDKNMPGALIAMGRMNIPSIFVYGGTIKPGHWEGQDLTVVSSFEAVGAYSAGKMDEATLTEIERHACPGAGSCGGMFTANTMSSAIEAMGMSLPYSSTMAAEDLEKAESAAESARVLVQAVLNDLRPRQILTRKAFENAIAVLMAVGGSTNAVLHLLAIARSVDVPLSIDDFEHIRRKVPVLCNLKPSGAYVATQLHAVGGIPLVMRMLLDNGLLHGDALTITGKTISETLRDVPSRPPAGQDVVLPFDKPVYREGHLAILKGNLAPEGSVAKISGIKHRSITGPARVFDSEERCMAAILAREIRPGDIVVIRYEGPKGGPGMREMLAPTSALIGEGLGDSVGLITDGRFSGGTYGMVVGHVSPEAAVGGPIGLVQEGDLITIDADRNLIEVKVSPDEMTRRKSLWKEPPLRYTKGIMAKYRLLVKSASEGAVTD

SEQ ID NO: 317 - DNA, 1677 bp, Leptospirillum sp.
atgaaagacaaccggagaagtcgtgtcacgaccgaaggcgtggagcgctctcccaaccgggccctgcttcgggccacggggttccgggacgacgattttggcaagccgattgtcggggtggcgaacgcccacagttccatcaccccctgcaatatggggatcgggaaactcgcttcgcgggcggaagaagctctccgcaaggccggctccatgccccagaccttcgggaccatcacggtgtcggacggaatctcgatgggcaccgaaggcatgaaatattccctcgtctcgagggaagtgattgccgattcgatcgaaacggtcgtgaacgcgcagagcatggacggccttctggcgttcgggggatgcgacaaaaacatgccgggggcactgatcgcgatgggccgtctcgacattccctccgtcttcgtctacggagggacgattcgtccgggacaccacaacggacaggacctgaccgtcgtcagcgccttcgaggccgtcggggaatatctcgcgaaccggatcgaccgggaagaacttctggcaatcgaacgccacgcctgtcccggagccggatcctgcggcgggatgtttaccgccaacaccatggcagccctgatcgaaaccatgggcatgagcctcccctattcctccacgatggccgccgaagacgcggaaaaatcggaaaacgcggaagagtccgcgaagatcctggtcaacgccatccggaaccagatccgtccccgccagattctgacgcggcatgccttcgaaaatgcgatcgcggtcacgatggccatcggagggacgaccaacgccgttctgcatctccttgccatcgcccgggcggtcgaggttccgctttcgatcgacgacttcgccgcaatccgggaacgggtccctgttctgtgcgatctcaagccatgggggcggtatgtggcaaccgaccttcaccgggcgggagggattccccaggtcatgaaaatcctgttgtcgaacggactgttgcatggggaagccctttccgtcaccggccggaccatcgcggaactgctggaaaacatcccggaagaccccccgaaagaagatcaggatgtgattcgtccgtttcgcgcgccggtcctcgaacgggggcatatcgccatcctccggggaaacctcgcccccgacggatcggtggccaaagtgacggcctcccgtcctgtggcattcacgggaccggcccgtgtcttcgattcggaagaagacggcatgaaggccattctggcaagagagatccgtccgggagatgtcgtagtcatccgttacgagggtcccgtgggaggaccgggcatgcgggaaatgctcgcaccgaccgccgcccttgtcggggaaggcctgggggagagcgtggcgctggtcacggatggacggttctccggaggaacccgggggatggtcgtgggtcatgttgcacccgaagcggccgtgggaggaccgatcgccctggttgccgacggcgatccggtcacggtcgaccccggacggagctgtctccggctcgatgtgccggaggaggaatttctccgccggcaggccgcatggcgtccccgtccgccccgcaccctccggggggttctggcgaagtacgcccggcaggtctcttcggccagcgaaggcgccgtcaccgactga

SEQ ID NO: 318 - protein, 558 aa, Leptospirillum sp.
MKDNRRSRVTTEGVERSPNRALLRATGFRDDDFGKPIVGVANAHSSITPCNMGIGKLASRAEEALRKAGSMPQTFGTITVSDGISMGTEGMKYSLVSREVIADSIETVVNAQSMDGLLAFGGCDKNMPGALIAMGRLDIPSVFVYGGTIRPGHHNGQDLTVVSAFEAVGEYLANRIDREELLAIERHACPGAGSCGGMFTANTMAALIETMGMSLPYSSTMAAEDAEKSENAEESAKILVNAIRNQIRPRQILTRHAFENAIAVTMAIGGTTNAVLHLLAIARAVEVPLSIDDFAAIRERVPVLCDLKPWGRYVATDLHRAGGIPQVMKILLSNGLLHGEALSVTGRTIAELLENIPEDPPKEDQDVIRPFRAPVLERGHIAILRGNLAPDGSVAKVTASRPVAFTGPARVFDSEEDGMKAILAREIRPGDVVVIRYEGPVGGPGMREMLAPTAALVGEGLGESVALVTDGRFSGGTRGMVVGHVAPEAAVGGPIALVADGDPVTVDPGRSCLRLDVPEEEFLRRQAAWRPRPPRTLRGVLAKYARQVSSASEGAVTD

SEQ ID NO: 319 - DNA, 1698 bp, Halorhodospira halophila
atggcggataaccgtcgcagccgagtgatcacccagggcgtggcccgaacccccaaccgcgcgatgctgcgcgccgtcggtttccgggatgaggatttcgagaagccgatcatcggggtcggcaacgcgcacagtacgatcaccccctgcaacgtcgggatcggcgccatggcgcggcgcgccgaggaggcgctgcgcgaggtgggggcgatgccgatgaagttcggcaccatcaccgtctccgacgggatcaccatgggcaccgagggcatgaagtactccctggtctcccgcgaggtgatcgccgattcgatcgagacggtgggcggtggccagcggatggacggcatgctcgccactggtggctgcgacaagaacatgcccggggcgatgatggccctggcccgtctggatatcccgggtatcttcgtctatggcggcaccatcaagccgggtcattacaagggcgaggatctcaccgtggtcagcgccttcgaggcggtggggcagtacaacgccggcaacctctccgaggccgatctcaagggggtcgaggagaacgcctgccccggggcgggcgcctgtggcggcatgttcacggccaacaccatgtccagcgccttcgaggccatgggcatgagcctgatgggctcgtccaccgtctctgccgaggacgacgaggcccgggatgtggccgccgaggcgtcccgggtcctgatggacgctgtccatcacgaccggcgcccgtcctcgatcctcacccgcgaggccttcgagaacgcctttgcggtggtgatggccctgggcggctccactaacgccgtgctccacctgctggccatcgccaataccgccgaggtgccgttcgacctcgacgacgtcgagcgcatccgccgcaaggtgccggtactctgcgacctcaagccgtcgggccggttcgtgaccagtcagttccacgaggtcggcggcacgccgcaggtgatgcgcatcctcctggagcaggggctgttgcacggccactgccagaccatcaccgggcagaccatcgaggccctcatcggccacctgccgccggagccgccggcggatcaggagatcatcatgcccttcgatcggccgctctatcccgagggtcacctggcaatcctgcggggcaacctggctgaagagggtgccgtggccaaggtcagtggcatccaacagcgccgtatcagcggaccggcccgcgtgttcgattccgaggaggagtgcctggaggccatcctggccgacggggtgcaggccggtgacgtggtgatcgtccgctacgaggggcccaagggagggcccggcatgcgcgagatgctggcgcccacctcggcgatcatcggcaaggggctcggcgatgcggtggggctgatcactgacggccgtttctccggcgggacctacgggatggtggtcgggcacgtggcgcctgaggcctacgacggcgggaccatcgcgctgattgccgagggcgatacggtgaccatcgacgccgaccagaacctgcttcaggtggaggtggatgacgcggagctcgagcgtcgccgcagccagtggcaggtgccccggcctcgctaccgtcgcggggtgttgggcaagtatgcgcgcctggcggcctcggccagtcgcggtgcagtgaccgacgccgacctcttccccgagcaggagtag

SEQ ID NO: 320 - protein, 565 aa, Halorhodospira halophila
MADNRRSRVITQGVARTPNRAMLRAVGFRDEDFEKPIIGVGNAHSTITPCNVGIGAMARRAEEALREVGAMPMKFGTITVSDGITMGTEGMKYSLVSREVIADSIETVGGGQRMDGMLATGGCDKNMPGAMMALARLDIPGIFVYGGTIKPGHYKGEDLTVVSAFEAVGQYNAGNLSEADLKGVEENACPGAGACGGMFTANTMSSAFEAMGMSLMGSSTVSAEDDEARDVAAEASRVLMDAVHHDRRPSSILTREAFENAFAVVMALGGSTNAVLHLLAIANTAEVPFDLDDVERIRRKVPVLCDLKPSGRFVTSQFHEVGGTPQVMRILLEQGLLHGHCQTITGQTIEALIGHLPPEPPADQEIIMPFDRPLYPEGHLAILRGNLAEEGAVAKVSGIQQRRISGPARVFDSEEECLEAILADGVQAGDVVIVRYEGPKGGPGMREMLAPTSAIIGKGLGDAVGLITDGRFSGGTYGMVVGHVAPEAYDGGTIALIAEGDTVTIDADQNLLQVEVDDAELERRRSQWQVPRPRYRRGVLGKYARLAASASRGAVTDADLFPEQE

SEQ ID NO: 321 - DNA, 1689 bp, Nitrococcus mobilis
atggccgataatcgccgcagccgcgtgatcacctacggtgtggcccgtacgcctaatcgggccatgctgcgcgctgtcggttttaccgacactgatttcgataaaccgatcgttggagtgggcaatgcccacagcaccatcacaccctgtaatgtgggcatcggtgcattagcggctcaggccgaacaggcgctgcgtgaagccggtgccatgccggtcagctttggcaccatcactatttctgatggtatatccatgggcacggaggggatgaagtactcgctggtctcgcgcgaggtcatagccgatgccatcgaaacggtaggcaacggccagtgcctggatggcatgctcgccaccggtggttgcgacaagaacatgccgggcgccatgattgccatagcacgcatgaatattccggcgatcttcgtttatggcggcaccatcaagccgggtcgctataagggtcaggatctgaccatcgtcagcgctttcgaggcggttggacagtatgccgccggcaaactctcagtcgaggatttgcagggcgtggaacgcaacgcttgccccggtgccggtgcctgcggcgggatgtacacggctaataccatgtccagcgccttcgaggccttgggtatgagcctgatgggctcctccaccctgtgcgcggaggatccggagaaagtgcagagtgcgcggcgctcggctcaagtcctggtagacgccatccaggaacagcgtttaccgcgtgccataatgacccgccaggcgttcgaaaacgcctttgcggtggtcatggcgctcggcggatcgaccaatgccgtgctgcatttgttggcgatcgccaacgctgcggaggtcgattttagcattgacgatgtcgaaaccatccgccgccaggtgcccgtgctctgcgagctcaagccctccgggcgcttcgtaaccagccagtttcatgaggtcggcggtactccgcaggtcatgaagatccttttggcccacggcttattgcacggcgcttgccttactgtttccgggcattctattgctgaattgttggccgacataccggccgagccgccgagcgaccaggatatcattcggcctttcaagcagccgctgtacccgcagggacatctcgccatcctgcgcggcaatctggcggaggagggtgccgtcgccaaggtcaccggcatcaaacagcgccggatcacaggtccggcacgggttttcgactccgaagagggtgccctggaggcgattctggcggatcaaatcgtggcgggtgacatcgtcgtgattcgttatgagggcccgaagggtgggccgggcatgcgcgagatgctggcgccgacctcggcgatcatcggtaaaggtttgggtgatgcggtaggtcttattaccgacgggcgcttctccggtggtacctatgggatggtggtcggtcatgttgcaccagaggcggcagtcggcggtacgattgccttggtgcgggagggtgatgaaatcacgatcgatgccgatcgcaatctgctgatgctccatgtcgccgacacggaaattgtccagcgccgagccgcctggcagccgccacggcctatttatcgtcgcggtgtgctcgcgaagtacgccaagttggtctcctcggcgagcattggagcggttacggacaaagatctattcgactga

SEQ ID NO: 322 - protein, 562 aa, Nitrococcus mobilis
MADNRRSRVITYGVARTPNRAMLRAVGFTDTDFDKPIVGVGNAHSTITPCNVGIGALAAQAEQALREAGAMPVSFGTITISDGISMGTEGMKYSLVSREVIADAIETVGNGQCLDGMLATGGCDKNMPGAMIAIARMNIPAIFVYGGTIKPGRYKGQDLTIVSAFEAVGQYAAGKLSVEDLQGVERNACPGAGACGGMYTANTMSSAFEALGMSLMGSSTLCAEDPEKVQSARRSAQVLVDAIQEQRLPRAIMTRQAFENAFAVVMALGGSTNAVLHLLAIANAAEVDFSIDDVETIRRQVPVLCELKPSGRFVTSQFHEVGGTPQVMKILLAHGLLHGACLTVSGHSIAELLADIPAEPPSDQDIIRPFKQPLYPQGHLAILRGNLAEEGAVAKVTGIKQRRITGPARVFDSEEGALEAILADQIVAGDIVVIRYEGPKGGPGMREMLAPTSAIIGKGLGDAVGLITDGRFSGGTYGMVVGHVAPEAAVGGTIALVREGDEITIDADRNLLMLHVADTEIVQRRAAWQPPRPIYRRGVLAKYAKLVSSASIGAVTDKDLFD

SEQ ID NO: 323 - DNA, 1692 bp, Alkalilimnicola ehrlichei
atgagtgagaaccgccgcagtcgggtcgtgaccgcaggcctgcgccgcacccccaaccgggccatgctgcgcgccaccggcttccgggacgaggacttcgacaagcccatcatcggcgtcgccaacgcccacagcaccatcaccccctgcaacatgcatatcgccgcgctcacccggcgggcggtggaggcgttgcaggcggccggtgccatggcaccggaatttggcgtgcccaccgtctcggacggcatcgccatgggcacgccggggatgcgctactcgctggtctcgcgcgaggtgatcgccgacgccatcgagacggtgtgcgagggccagagcctggacggcgtgctggccaccggcggctgcgacaagaacatgcccggggctatgatcgccatcgcgcgcatgaacataccggccctgtttgtctacggcggcaccatccgccccggctactacaagggcgagcggctggacatcgtctcggcgttcgaggcggtgggccaggcctccgcgggcaggatgagtgacgaggacctgcttggggtggagcgcaacgcctgccccggcgccggctcctgtggcgggatgtacaccgccaacaccatgtccagcgccttcgaggccatgggcatgagcctgcccgccagctccaccgtggccgccgaggcggaggagaagggcgacgacgtggcggccgccgcgcgggtgctgatggaggcggtgcgggcggatcgcaagccccgcgacatcctcacccgcgaggccttcgagaacggcttcgccctggtgatggccgtgggcgggtccaccaacgcggtgctgcacttgctggccatcgccgatgcggccgatgtgccgttgtcgctggacgacgtggagcgtatccggcagcaggtgcccgtgctctgcgatctgcggccctcgggccgctacgtgaccactgaatttcacgaggtgggcggcacgccgcaagtgctgcgcctgctgctggacgcgggcctgctccacggcgactgcctcactattaccgggcagacgcttgccgagaccctggccgacgtgcccccgacccccgcgaaggatcaggacatcatccggaccctggacaaccccctctacccggtgggccatctggccatcctgcgtggaaacctggcagaggagggggccgtggccaaggtgtccggccttaagcagcgccgcatcgtcggaccggcgcgggtattcgagggtgaggaggactgcctggaggcgatcctggccggccagattaagcccggcgacgtggtggtcatccgccacgaggggccgaagggcgggcccggcatgcgcgagatgctctcgcccaccgcggcgttgatgggggccgggctgggggagagcgtcggcctgatcaccgatgggcgcttctccggtggcacccgggggctggtggtgggccacgtggcgccggaggccgcagcgggtggcaccatcgccctggtccgggaaggcgacaccgtcaccatcgatgcggacgccaaccggctcaccctggaggtggacgaggcggagctcgcccgccggcgtgcggcctggcagccgccggaaccgagagcgacccggggcgtattgggcaagtacgcgcagatggtcggctcggcggcgcagggtgcggtcaccgatcgctggagcggcggcgcgtga

SEQ ID NO: 324 - protein, 563 aa, Alkalilimnicola ehrlichei
MSENRRSRVVTAGLRRTPNRAMLRATGFRDEDFDKPIIGVANAHSTITPCNMHIAALTRRAVEALQAAGAMAPEFGVPTVSDGIAMGTPGMRYSLVSREVIADAIETVCEGQSLDGVLATGGCDKNMPGAMIAIARMNIPALFVYGGTIRPGYYKGERLDIVSAFEAVGQASAGRMSDEDLLGVERNACPGAGSCGGMYTANTMSSAFEAMGMSLPASSTVAAEAEEKGDDVAAAARVLMEAVRADRKPRDILTREAFENGFALVMAVGGSTNAVLHLLAIADAADVPLSLDDVERIRQQVPVLCDLRPSGRYVTTEFHEVGGTPQVLRLLLDAGLLHGDCLTITGQTLAETLADVPPTPAKDQDIIRTLDNPLYPVGHLAILRGNLAEEGAVAKVSGLKQRRIVGPARVFEGEEDCLEAILAGQIKPGDVVVIRHEGPKGGPGMREMLSPTAALMGAGLGESVGLITDGRFSGGTRGLVVGHVAPEAAAGGTIALVREGDTVTIDADANRLTLEVDEAELARRRAAWQPPEPRATRGVLGKYAQMVGSAAQGAVTDRWSGGA

SEQ ID NO: 325 - DNA, 1695 bp, Deinococcus geothermalis
atgacggacacccgcaccaagcgcagaatgaactggaacagtcaccacatcacgcagggtgacgagcgggcgcccaaccgcgcgatgctgcgggcggtgggcttcgaagacggcgacttcgacaaggcgatcatcggggtggcgcacgcccagagcaacatcacgccctgtaacaacgggctgggcgaactcgccgaccacatcaccggtgcgcttcgcgagggcggagcgatgccgcaggtgtacggcaccatcacggtgtctgacggcatcagcatgggcaccgagggcatgaagtgctctcttgtcagccgggaagtgatcgcagactccatcgaaaccgtctcgcgtgggcaatcgcacgacggcctgattgtggtgggcggctgcgacaagaatatgcccggcgcaatgatcggcatcgcccggttgaatattcccgcgatcttcgtgtacggcgggaccatcaaaccggggcactatcagggcaaagacctcaccatcgtttcggtcttcgaggcggtgggggcctacggcgcgggcaagatgagccgcgaggacttcgagcagatcgagaaacgcgcctgtcccggcaacggttcctgtggcggcatgtacaccgccaacaccatgagcagtgccttcgaggcgatgggcatgagcctgccctattcgtccaccatgagtgccgtggacgccgaaaaggccgtttcggctgcggacagcgcccgcgccctgatccggttgatcgagcaggacatccgcccgctggacatcctgacgaaaaaagcctttgagaacgccatcacggtggtcatggcggtgggcggctcgaccaacgccgtgctgcacctgatggcgattgcccacgcctgcggtgttgacctcacgctggaagacttcgagcgcattcgcgagcgcacgccggtcttctgtgaccttaagcccagtggaaagtacgtcgccacggatctgcacgaggtcggcggcattccgcgcgtgatgaagatgctgctcaaagcgggcttgctgcacggcgactgcctgacagtgaccggacagacggtggccgagaacctggcggacgtgcccgaccagcccgaccccggccaggacgtcattctgcccttcgatcagccgctctactcgcaggggcacctcgccatcttgcggggcaacctggccccggaaggcagtgtcgccaagatcagcggcctgcggcagatcaagatcaccggtcccgcccgcgtctttgattcggaagaagagtgcatggcggcgatcatgggcgatcagatcaaggccggtgacgtgatcgtgattcgctacgaaggccctaagggcggccccggcatgcgcgagatgctctcgcccaccagcgcgatcatcggcaaaggcctgggcgacagcgtggggctgatcacagacggacgcttcagcggcggcacctacggcctggtggttggccacgtcgcgcccgaagcctatgtaggcggccccatcgcgctggtgcaggaaggcgacatcatcgagctgaacgccgaaacctgcgagctgacgctgcatgtggacgacgcagaactggagcgccgccgcgccgcgtgggtggccccggaaccgcgctaccggcggggcgtcctggcaaagtacgcgcgactagtaggcagtgcggcgcggggagcggtgaccgattag

SEQ ID NO: 326 - protein, 564 aa, Deinococcus geothermalis
MTDTRTKRRMNWNSHHITQGDERAPNRAMLRAVGFEDGDFDKAIIGVAHAQSNITPCNNGLGELADHITGALREGGAMPQVYGTITVSDGISMGTEGMKCSLVSREVIADSIETVSRGQSHDGLIVVGGCDKNMPGAMIGIARLNIPAIFVYGGTIKPGHYQGKDLTIVSVFEAVGAYGAGKMSREDFEQIEKRACPGNGSCGGMYTANTMSSAFEAMGMSLPYSSTMSAVDAEKAVSAADSARALIRLIEQDIRPLDILTKKAFENAITVVMAVGGSTNAVLHLMAIAHACGVDLTLEDFERIRERTPVFCDLKPSGKYVATDLHEVGGIPRVMKMLLKAGLLHGDCLTVTGQTVAENLADVPDQPDPGQDVILPFDQPLYSQGHLAILRGNLAPEGSVAKISGLRQIKITGPARVFDSEEECMAAIMGDQIKAGDVIVIRYEGPKGGPGMREMLSPTSAIIGKGLGDSVGLITDGRFSGGTYGLVVGHVAPEAYVGGPIALVQEGDIIELNAETCELTLHVDDAELERRRAAWVAPEPRYRRGVLAKYARLVGSAARGAVTD

SEQ ID NO: 327 - DNA, 1695 bp, Polynucleobacter sp.
atgaaacgcctcaatgaacgctctcgcatggttaccgagggggtcgctcgcgcacccaatcgttcgatgtactacgcgatgggttacgaagaaaaggatttcgtaaaaccaatggttggcgttgcaaacggccactccactattaccccttgcaatagtggcttacaaaaattagctgatgccgcagttgaagctctagaagcagctggcgcaaaagcacaagtatttggtacgccaaccgtttctgatggtattggtatgggtactgagggtatgaagtattccctcgtctcacgagaagtgattgctgacagtattgaagtttgtgtaaacggtctttggcaagatggcgtagtagtcattggtggctgcgataaaaatatgcctggtggcatgatggctttagctcgcacgaatgtacctggcatctatgtatatggtggcacgattaagccaggccactttaaaggcaaggaattgaatattgtttctgcatttgaagcagttggtgaatttacctccggtcgattgagtgaagaagatttaaaaggtgttgagcaacacgcctgcccaggtagcggctcttgcggtggaatgtacacggccaataccatgagctcttcatttgaggctttgggtatgagcttgccctactcttctacgatggcaaacgttgacgctgaaaaagtagcgagcgctgccgaatcagcgcgcgtcctcgttgaagccgttaaaaacaacctgcgcccacgcgacatcattaccaagaaatccgttgagaatgcggttagcgtcatcatggcagttggcggttcaaccaatgcagtgttgcatttcttggcgattactagtgccgctgaaattgattggacaattgatgactttgaacggattcgtaagcaagtcccagtcatcgttgatatgaaaccctctggcacttatttagcaactgacttacaccaagctggcggtattccacaagtcatgaagattttgcttgacggtggcctgcttcatggcgattgcatcaccattaccggaaaaactattgctgaagtattaaaagatgttccatcagtgccgcgcgctgatcaaaaagtcattcgcacgctagacaacccactctacaagcaaggtcacttagcgattctgaagggcaatatttctccagaagggtgcgttgccaaaattactggcctcaagaatccatcgattactggcccagctcgagtctttgattctgaagatgatgcgatggctgccatcatggctcagaagatcaaagatggcgacatcgtggtgattcgttacgaaggccctaaaggcggtcctggtatgcgtgaaatgcttgcccctacctctgccctagttggtcaaggtttaggcgagtcagttggcctcatcaccgatggtcgcttctctggtggtacttggggcatggtagttggtcacgttgctcctgaggcctttgtagggggcacaattgccctcatcaacgaaggtgactcagtcacgatagatgctcaccaacttcttattcagctcaacgtcagcgaagaagaaattgctaagcgacgcgcagcttggaaacaacctaagccacgctatacccgcggcttacttgcgaagtatgcaagccttgctagtagtgcgagcaaaggtgctgtaaccgatttgaatttagatttgacctaa

SEQ ID NO: 328 - protein, 564 aa, Polynucleobacter sp.
MKRLNERSRMVTEGVARAPNRSMYYAMGYEEKDFVKPMVGVANGHSTITPCNSGLQKLADAAVEALEAAGAKAQVFGTPTVSDGIGMGTEGMKYSLVSREVIADSIEVCVNGLWQDGVVVIGGCDKNMPGGMMALARTNVPGIYVYGGTIKPGHFKGKELNIVSAFEAVGEFTSGRLSEEDLKGVEQHACPGSGSCGGMYTANTMSSSFEALGMSLPYSSTMANVDAEKVASAAESARVLVEAVKNNLRPRDIITKKSVENAVSVIMAVGGSTNAVLHFLAITSAAEIDWTIDDFERIRKQVPVIVDMKPSGTYLATDLHQAGGIPQVMKILLDGGLLHGDCITITGKTIAEVLKDVPSVPRADQKVIRTLDNPLYKQGHLAILKGNISPEGCVAKITGLKNPSITGPARVFDSEDDAMAAIMAQKIKDGDIVVIRYEGPKGGPGMREMLAPTSALVGQGLGESVGLITDGRFSGGTWGMVVGHVAPEAFVGGTIALINEGDSVTIDAHQLLIQLNVSEEEIAKRRAAWKQPKPRYTRGLLAKYASLASSASKGAVTDLNLDLT

SEQ ID NO: 329 - DNA, 1692 bp, Polynucleobacter necessarius
atgaaacgcctaaatgaacgctcgcgcatggtcacagaaggggtcgcacgcgcacctaatcgttcgatgtattacgcaataggttacgaagaaaaggatttcgtaaagccaatggttggcgttgcgaatggtcactccactatcaccccttgtaatagtggtttacaaaaattagccgatgctgcagtttctgcgcttgaaggtgctggtgcaaaagcacaaatgtttggcaccccaaccgtttccgatggcataggcatgggcacagaaggcatgaagtattcactcgtgtcacgcgaagtgattgctgacagtattgaaacttgtgtaaatggactgtggcaagacggtgtagttgtgattggcggctgcgataaaaatatgccaggcggcatgatggctttagctcgcaccaatgtgcccggcatctatgtatatggcggcacaattaagccaggccactacaaaggtaaagaccttaatatcgtttcagcgtttgaagcagttggtgaatttacctccggcagactcagcgaagaggatttaaaaggtgtagaacaacatgcctgtccgggtagcggctcctgcggtggtatgtataccgccaacacaatgagctcggcctttgaggccttaggcatgagcctcccctactcctcaacgatggcaaacgaagatgcagaaaaagtagcaagcacacatgattctgctgtcgtattggttgaagcgatcaaaaagaacttgcgtccacgcgacatcattaccaagaaatcgattgagaacgctgttagcgtaatcatggctgttggtggatctacaaatgcggtgctgcatttcttggcgattactagcgccgctgaaatcgattggaccattgatgattttgaacgcattcgtaagcgcgttcctgtaatcgtggatatgaaaccatcgggcacctaccttgctaccgatttgcatcaagctggcggcattcctcaagtgatgaagattttgctcgacgacggattgctccacggcgattgcatgactatcactggcaaaacagttgcggaagtgttgaaagatgttccatccgtaccgcgcgccgatcagaaagtgatccgtaccttagataatcctttgtataaacaaggtcacttggcaatcttgaaaggcaatatctcaccagagggttgtgtgaccaagataaccggcctcaaaaatccatcgatcaccggcccagcacgcgtctttgattctgaagatgatgctatggcagccatcatggcacagaagattaaagatggtgacatcgtggtcattcgctatgaaggccctaaaggcggccctggtatgcgcgaaatgcttgcccccacctctgccctagttggtcaaggtttaggcgaatctgtggggcttattaccgatggccgcttctctggtggcacttggggcatggtcgttggccacgtggcaccggaagcttatgtcggtggaaccatcgccctcattcatgagggtgactctgtcacgatcgatgcgcataagctactcattcagctgaatgtagatgatgcagagatcgctaaacgtcgcgcagcctggaagcaacccaagccacgctacacccgcggcttgcttgcaaagtatgccaaacttgctagcaccgcaagcaaaggggcggtgaccgacttaaatttgaatgattag

SEQ ID NO: 330 - protein, 563 aa, Polynucleobacter necessarius
MKRLNERSRMVTEGVARAPNRSMYYAIGYEEKDFVKPMVGVANGHSTITPCNSGLQKLADAAVSALEGAGAKAQMFGTPTVSDGIGMGTEGMKYSLVSREVIADSIETCVNGLWQDGVVVIGGCDKNMPGGMMALARTNVPGIYVYGGTIKPGHYKGKDLNIVSAFEAVGEFTSGRLSEEDLKGVEQHACPGSGSCGGMYTANTMSSAFEALGMSLPYSSTMANEDAEKVASTHDSAVVLVEAIKKNLRPRDIITKKSIENAVSVIMAVGGSTNAVLHFLAITSAAEIDWTIDDFERIRKRVPVIVDMKPSGTYLATDLHQAGGIPQVMKILLDDGLLHGDCMTITGKTVAEVLKDVPSVPRADQKVIRTLDNPLYKQGHLAILKGNISPEGCVTKITGLKNPSITGPARVFDSEDDAMAAIMAQKIKDGDIVVIRYEGPKGGPGMREMLAPTSALVGQGLGESVGLITDGRFSGGTWGMVVGHVAPEAYVGGTIALIHEGDSVTIDAHKLLIQLNVDDAEIAKRRAAWKQPKPRYTRGLLAKYAKLASTASKGAVTDLNLND

SEQ ID NO: 331 - DNA, 1704 bp, Azoarcus sp.
atgtccgaccctacccgtccagcccggatcgatgaacgttcccgcaacgtgaccgaaggcgtgatgcgggcgcccaatcgatcgatgtactacgcgatgggctatcgggaaactgatttcggcaagccgatggttggcgtggcgagcgcacattcgacgatcacgccctgcaacagcgggctgcaaccgctggccgataccgtggccgcggccttgaaggaggccggggccaatccgcaactgttcggtactcccaccgtgtccgacggcatcggcatgggcaccgagggcatgaagtattcgctggtatcgcgggaagtgatcgccgacagcatcgagacctgcgtcaatgggctgtggcaggacggggtcgtcgtgatcggcggatgcgacaagaacatgcccggcggcatgatggcgcttgtccgcaccaacgtgcctggaatctatgtctatggcggcacgatcaaaccggggcattacaagggcagggatctgaacatcgtctcggttttcgaggcggtgggggaattcatcgcggggcagctcgacccggtcgatttcaaggaaatcgaaaagcgcgcctgccccggcagcggctcgtgcggcgggatgtacacggcaaacacgatgagcgccgcgttcgaggcgctcggcatgagcctgccatattcttcgacgatggccaacgaggacgctgagaagctcgcgagcgccgcggagtccgcccgggtgctggtggaggcgatcaaacgcggccttcgcccgcgcgacatcgtcacccgggaggcgatcgagaacgctgtcagcgtgatcatggcgacgggaggctcgaccaacgcggtgctgcactttctggcgattgcccacgcggccgaagtgccgtggacaatcgacgacttcgagcgcattcggcgtcgcgtgccggtcatcgtcgacatgaagccgtccgggcgctacctcgcgaccgatctccatcaggcaggcggcatcccgcaggtgatgaagctgctgctcgacgccgggctgctgcatggcgcgtgcgtcacgatcaccgggcagacgatcgcggaggtcctggagaacgtgccggcggcaccgcgtgccgatcagggcgtcatccggacgctgtccgatccgctgtacgcggagggccatctggcgatcctcaggggcaacctctcgccggaaggctgcgtggcgaagatttcgggcctgaagaatcccgccatcaccggcccggcgcgcgtcttcgactccgaggacgacgcgatggcggcgatcatggcgcgccggatcgtggagggtgacgtcgtggtaatccgctacgagggacccaagggcggccccggcatgcgcgagatgctcgccccgacgtcggcgctcgtcgggcaggggctgggagagtcggtcgggctgatcactgacggccgcttctcgggaggcacctggggcatggtcgtcggccacgtttcccccgaagcgttcgtcggtggcccgattgcgctggttcgcgaaggggactcggtcacgatcgacgcgcaccggcagctcgtccagctgaatgtcggtgatgaagagctcgcgcgccgagccgccgactggacgccgccgtccccgcgctacacccgcggcgtgctggcgaagtttgcgaagttcgccagttccgcgagcaagggcgcggttaccgatctggacttgtag

SEQ ID NO: 332 - protein, 567 aa, Azoarcus sp.
MSDPTRPARIDERSRNVTEGVMRAPNRSMYYAMGYRETDFGKPMVGVASAHSTITPCNSGLQPLADTVAAALKEAGANPQLFGTPTVSDGIGMGTEGMKYSLVSREVIADSIETCVNGLWQDGVVVIGGCDKNMPGGMMALVRTNVPGIYVYGGTIKPGHYKGRDLNIVSVFEAVGEFIAGQLDPVDFKEIEKRACPGSGSCGGMYTANTMSAAFEALGMSLPYSSTMANEDAEKLASAAESARVLVEAIKRGLRPRDIVTREAIENAVSVIMATGGSTNAVLHFLAIAHAAEVPWTIDDFERIRRRVPVIVDMKPSGRYLATDLHQAGGIPQVMKLLLDAGLLHGACVTITGQTIAEVLENVPAAPRADQGVIRTLSDPLYAEGHLAILRGNLSPEGCVAKISGLKNPAITGPARVFDSEDDAMAAIMARRIVEGDVVVIRYEGPKGGPGMREMLAPTSALVGQGLGESVGLITDGRFSGGTWGMVVGHVSPEAFVGGPIALVREGDSVTIDAHRQLVQLNVGDEELARRAADWTPPSPRYTRGVLAKFAKFASSASKGAVTDLDL

SEQ ID NO: 333 - DNA, 1674 bp, Burkholderia phymatum
atgccgtacaaccgtcgttcgaagaacatcacgcaaggcgtcgcgcgttcgccgaaccgctcgatgtattacgcgctcggctaccagaaggcagacttcgacaagccgatgatcggcatcgccaacggccactcgaccatcacgccgtgcaacgcgggcctgcaacgactcgccgacgccgccgtcgaagccgtcaagcgcagcgatgcgaatccgcagaccttcggtacgccgaccatttcggacggcatgtcgatgggcacggagggcatgaagtactcgctcgtgtcgcgcgaagtgatcgccgactgcatcgagacctgcgtgcaggggcaatggatggacggcgtcgtcgtgatcggcggctgcgacaagaacatgccgggcggcatgatcggcctcgcgcgaatgaacgtgccaggcatctacgtgtacggcgggaccatcaagccgggcaactggaaaggcaccgacctgactatcgtgtcgtcgttcgaggcagtgggcgaattcacggcgggccgcatgtcgcaagaagacttcgaaggggtcgaacagaacgcctgcccgagcacgggctcgtgcggcggcatgtacacggccaacacgatgagctcgtcgttcgaagcgctcggtatgtcgctgctgtactcgtcgacaatggcgaacccggatcaggagaaagtggattcggcggccgagtcggcgcgcgtgctggtcgaagccgtcaagcaggatctcaagccgcgcgacatcattacgaagaagtcgatcgaaaacgccgttgcgctgatcatggcgacgggcggctcgacgaacgccgtgctgcactatctggccattgcgcacgcggcggaagtggactggtccatcgaagatttcgagcgcatgcgcaagaaagtgcccgtcatctgcgatctcaagccgtcgggcaagtatgtcgccaccgatctgcacaaggccggcggcatcccgcaggtgctgaagctgctgctcgatgcaggcctgctgcacggcgactgcatcacgatcacgggcaagacgatcgccgaagagctgaaggacgtgccagccaaaccgcgcgcggaccagaaggtgatctatccgatcgacaaggcgctttacagcgaaggccatctcgcgattctcaagggcaacctcgcggaagacggcgcggtcgcgaagatcaccgggctgaagaaccccgtcatcacagggcccgcacgcgtgttcgacgacgagcaaagtgcgatggaagccatcctcgccgaccagatcaaggcaggcgatgtcgtcgtgctgcgctatctcggcccgcaaggcggccccggcatgccggaaatgctggcgccgacctcggcgatcatcggcaagggtctcggcgaatcggtcggtcttatcacggatgggcgcttctcgggcggcacctggggcatggtggtgggtcacgtcgcgccggaagcgttcgtcggcggcacgatcgcactcgtgcaggaaggcgattcgatcaccatcgacgcccacaagctgctgttgcaactgaacgtcgacgacggcgaactgcagcgccgccgcgccgcatggaagcagcccgcgccgcgctatacgcgcggcgtgctggccaagttcgcggcgctcgcgaagccggccaacaagggcgccgtcaccggctga

SEQ ID NO: 334 - protein, 557 aa, Burkholderia phymatum
MPYNRRSKNITQGVARSPNRSMYYALGYQKADFDKPMIGIANGHSTITPCNAGLQRLADAAVEAVKRSDANPQTFGTPTISDGMSMGTEGMKYSLVSREVIADCIETCVQGQWMDGVVVIGGCDKNMPGGMIGLARMNVPGIYVYGGTIKPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIITKKSIENAVALIMATGGSTNAVLHYLAIAHAAEVDWSIEDFERMRKKVPVICDLKPSGKYVATDLHKAGGIPQVLKLLLDAGLLHGDCITITGKTIAEELKDVPAKPRADQKVIYPIDKALYSEGHLAILKGNLAEDGAVAKITGLKNPVITGPARVFDDEQSAMEAILADQIKAGDVVVLRYLGPQGGPGMPEMLAPTSAIIGKGLGESVGLITDGRFSGGTWGMVVGHVAPEAFVGGTIALVQEGDSITIDAHKLLLQLNVDDGELQRRRAAWKQPAPRYTRGVLAKFAALAKPANKGAVTG

SEQ ID NO: 335 - DNA, 1674 bp, Burkholderia xenovorans
atgccatacaaccgtcgttcgaagaacatcacgcaaggtgtagcgcgttcgccgaatcgctcgatgtactacgcgctcggctacgaaaaagccgacttcgacaagccgatgatcggcatcgccaacggtcactcgaccatcacgccgtgcaacgcgggcctgcagcgtctcgccgatgccgcggtcgccgcgatcaaaggcgccgacgcgaacccacagatcttcggcacgccgacgatctcggacggcatgtcgatgggcaccgagggcatgaagtactcgctggtgtcgcgcgaagtgatttccgactgcatcgagacctgcgtgcaaggccagtggatggacggcgtggtcgtgatcggcggctgcgacaagaacatgccgggcggcatgatcggcatgctgcgcaccaacgtgccgagcatctacgtgtatggcgggacgattcgtccgggcaactggaagggcaccgacctgaccatcgtgtcgtcgttcgaggccgtgggcgaattcaccgccggccggatgtcgcaggaagatttcgaaggggtcgaacagaacgcgtgcccatccaccgggtcgtgcggcggcatgtacaccgccaacaccatgagctcgtcgttcgaagcgctcggcatgtcgctgctgtattcgtccacaatggccaatccggatcaggaaaaagtcgactcggccgccgaatcggcacgcgtgctggtcgaagcggtcaagcaggatctcaagccgcgcgacatcgtgacccgcaagtcgatcgaaaacgccgtggccgtgatcatggccaccggcggctcgaccaatgccgtgctgcactttctcgccatcgcgcatgcggccgaagtggagtggagcatcgaggacttcgagcgcatgcgcaagaaggtgccggtgatctgcaacctgaagccgtcgggccagttcgtggcgaccgatctgcacaaggccggcggcattccgcaagtcatgaagatcctgctcgacgcaggtctgttgcacggcgattgcatcacgatcaccggccgaaccctcgcggaagagttgaaggacgtgccggccaggccgcgcgccgatcagcaggtgattttcccgatcgagcaggcgctgtacaaggaaggccatctcgcgatcctcaagggcaacctggccgtggacggcgcggtcgccaagatcaccggcctgaagaatcccgtgatcaccggcccggcgcgcgtgttcgacgacgagcaaagcgcgctggaagcgattctggccgacaggatcgtcgcgggcgacgtggtggtgctgcgctatctcggcccgaagggcggccccggcatgccggagatgctcgcgccgacctcggcgatcatcggcaagggactcggcgagagcgtggggctcatcaccgacgggcgcttctcgggtggcacgtggggcatggtggtcgggcacgtcgcgccggaagccttcgtgggcggcacgatcgcgttcgtgcaggaaggcgactcgatcaccatcgacgcgcacaagctgctgctgcaactgaatatcgacgacgccgaactggagcgacgccgtgccgcatggcagcagccgaagccgcgctacacacgcggcgtgctggcgaagtactccgcattggctctgccggccaataagggcgccgtgacgggctaa

SEQ ID NO: 336 - protein, 557 aa, Burkholderia xenovorans
MPYNRRSKNITQGVARSPNRSMYYALGYEKADFDKPMIGIANGHSTITPCNAGLQRLADAAVAAIKGADANPQIFGTPTISDGMSMGTEGMKYSLVSREVISDCIETCVQGQWMDGVVVIGGCDKNMPGGMIGMLRTNVPSIYVYGGTIRPGNWKGTDLTIVSSFEAVGEFTAGRMSQEDFEGVEQNACPSTGSCGGMYTANTMSSSFEALGMSLLYSSTMANPDQEKVDSAAESARVLVEAVKQDLKPRDIVTRKSIENAVAVIMATGGSTNAVLHFLAIAHAAEVEWSIEDFERMRKKVPVICNLKPSGQFVATDLHKAGGIPQVMKILLDAGLLHGDCITITGRTLAEELKDVPARPRADQQVIFPIEQALYKEGHLAILKGNLAVDGAVAKITGLKNPVITGPARVFDDEQSALEAILADRIVAGDVVVLRYLGPKGGPGMPEMLAPTSAIIGKGLGESVGLITDGRFSGGTWGMVVGHVAPEAFVGGTIAFVQEGDSITIDAHKLLLQLNIDDAELERRRAAWQQPKPRYTRGVLAKYSALALPANKGAVTG

SEQ ID NO: 337 - DNA, 1674 bp, Burkholderia multivorans
atgtcgtacaaccgtcgctcgaagcacatcacgcaaggcgtcgcccgctcgccgaaccgttcgatgtattacgccctcggctatcagaaggaagatttcgacaagccgatgatcggcatcgccaacgggcattcgacgatcacgccgtgcaacgcggggctgcagcgcctgtccgacgcggccgtcgaggcgatcaaggcggccggcgcgaatccgcagatcttcggcacgcccacgatctcggacggcatgtcgatgggcaccgaagggatgaagtactcgctcgtgtcgcgcgaggtaatcgccgactgcatcgagacctgcgtgcagggccaatggatggacggcgtcgtggtagtcggcggctgcgacaagaacatgccgggcgggatgatcgcgctcgcgcggctgaacgtgccgggcatctacgtgtacggcgggacgatccgccccggccactggaaaggcaaggatctgacgatcgtctcggcgttcgaggcggtcggcgaattcacggccgggcgcatgtcggacgaggatttcgagggcatcgagcgcaacgcgtgcccgacgtcgggctcgtgcggcggcatgtacaccgcgaacacgatgagctcgtcgttcgaggcgctcggcatgtcgctgatgtattcgtcgacgatggcgaaccccgatcaggaaaaggtcgattcggcggccgaatcggcgcgtgtgctcgtcgaagcggtgaagcgcgacctgaagccgcgcgacatcatcacgaagcagtcgatcgagaacgcggtgtcgctgatcatggcgaccggcggctcgaccaatgcggtgctgcactatctcgcgatcgcgcatgcggccgaggtcgactggacgatcgacgacttcgagcggatccgcaagcgcgtgccggtgatctgcgacctgaagccgtcgggccagtacgtcgcgaccgacctgcaccgtgcgggcggcattccgcaggtgctgaagatcctgctcgatgcgggcctgctgcacggcgactgcgtcacgatcaccggccgcacgctcgccgaagagctgaaggacgtgccgtccgtgccgcgcgccgatcagcaggtgatcttcccgatcgagcgcgcgctgtacaaggagggccatctcgcgatcctgaagggcaatctcgccgaggacggcgcggtcgcgaagatcaccggcctgaagaacccggtgatcacgggcccggcgcgcgtgttcgacgacgagcaaagcgcgatggacgcgatcctcggcgacaagatccgcgccggcgacgtgctcgtgctgcgctatctcggcccgcaaggcgggcccggcatgccggaaatgctcgcgccgacgtcggcgatcatcggcaaggggctcggcgaatcggtcggcttcatcaccgacggccgcttctccggcggtacgtgggggatggtcgtcggccacgtcgcgcccgaggcgttcgtcggcggcacgatcgcgctcgtgcaggaaggcgactcgatcacgatcgacgcgcataagctgctgctgcagctgaacgtcgacgatgcggaactcgcgcgccgccgcgccgcatggaagcagccggcgccgcgctacacgcgcggcgtgctcgccaagtatgccgcgctcgcacggccggcgaatcggggtgcggtcacggggtga

SEQ ID NO: 338 - protein, 557 aa, Burkholderia multivorans
MSYNRRSKHITQGVARSPNRSMYYALGYQKEDFDKPMIGIANGHSTITPCNAGLQRLSDAAVEAIKAAGANPQIFGTPTISDGMSMGTEGMKYSLVSREVIADCIETCVQGQWMDGVVVVGGCDKNMPGGMIALARLNVPGIYVYGGTIRPGHWKGKDLTIVSAFEAVGEFTAGRMSDEDFEGIERNACPTSGSCGGMYTANTMSSSFEALGMSLMYSSTMANPDQEKVDSAAESARVLVEAVKRDLKPRDIITKQSIENAVSLIMATGGSTNAVLHYLAIAHAAEVDWTIDDFERIRKRVPVICDLKPSGQYVATDLHRAGGIPQVLKILLDAGLLHGDCVTITGRTLAEELKDVPSVPRADQQVIFPIERALYKEGHLAILKGNLAEDGAVAKITGLKNPVITGPARVFDDEQSAMDAILGDKIRAGDVLVLRYLGPQGGPGMPEMLAPTSAIIGKGLGESVGFITDGRFSGGTWGMVVGHVAPEAFVGGTIALVQEGDSITIDAHKLLLQLNVDDAELARRRAAWKQPAPRYTRGVLAKYAALARPANRGAVTG

SEQ ID NO: 339 - DNA, 1686 bp, Burkholderia cenocepacia
atggagctccccatgtcgtacaaccgccgctctaagaacatcacgcaaggcgtggcccgttcgccgaaccgctcgatgtattacgccctcggctaccagaaggacgatttcgataaaccgatggtcggtatcgcgaacggccactcgacgatcacgccgtgcaattccggcctgcagcgcctgtcggacgcggccgtggatgccgtgaaggcggccggcgcgaacccgcagatcttcggcacgccgacgatttcggacggcatgtcgatgggcaccgaagggatgaagtactcgctcgtgtcgcgcgaagtgatcgccgactgcatcgagacctgcgtgcagggccagtggatggacggcgtggtggtggtcggcggctgcgacaagaacatgcccggcggcatgatcgcgctcgcacgcctgaacgtgccgggcatctacgtgtacggcggcacgatccgcccgggcaactggaagggccgcgacctgacgatcgtgtcgtcgttcgaggccgtcggcgaattcaccgcgggccggatgtcgcaggaagacttcgaaggcgtcgagaagaacgcgtgcccgacgtcgggttcgtgcggcggcatgtacaccgcgaacacgatgagttcgtcgttcgaggcgctcgggatgtcgctgctgtattcgtcgacgatggcgaaccccgaccaggaaaaagtcgattcggccgccgaatcggcacgcatgctggtcgaggcggtgaagcgcgacctgaagccgcgcgacatcatcacgaaggaatccatcgagaacgcggtgtcggtgatcatggccaccggcggctcgaccaatgcggtgctgcactatctcgcgatcgcgcacgcggccgaagtcgactggacgatcgacgacttcgagcgcattcgcaagcgcgtgccggtgatctgcgacctgaagccgtcgggacaatacgtcgcgaccgacctgcaccgggccggcgggattccgcaggtgctgaagatcctgctcgatgcagggctgctgcacggcgactgcatgacgatcaccggccgcacgatcgccgacgagctgaaggacgtgccggccgtgccgcgcgcggaccagcatgtgatcttcccgatcgaccgcgcactgtacaaggaaggccacctcgcgatcctgaagggcaatctcgcggaagacggcgcggtcgcgaagatcaccggcctgaagaacccggtgatcacgggcccggcgcgcgtgttcgacgacgaacagagcgcaatggacgcgatcctcggcgaccggattcgcgcgggcgacatcctcgtgctgcgctacctcggcccgcagggtggccccggcatgccggaaatgctcgcgccgacttccgcgatcatcggcaaggggctcggcgaatcggtcggcttcatcacggacggacgcttctcgggcggcacttggggcatggtggtcggccacgtcgcgccggaggcgttcgtcgggggcacgatcgcgctggtgcaggaaggcgattcgatcacgatcgacgcgcaccggctgctgctgcaactgaacgtcgacgaggcggaactcgcacggcgccgtgccgcgtggcgacagccggcgccgcgctatacgcgcggggtgctcgcgaaattcgcggcgctcgcccgaccggcgaaccagggagcggtcacgggttga

SEQ ID NO: 340 - protein, 561 aa, Burkholderia cenocepacia
MELPMSYNRRSKNITQGVARSPNRSMYYALGYQKDDFDKPMVGIANGHSTITPCNSGLQRLSDAAVDAVKAAGANPQIFGTPTISDGMSMGTEGMKYSLVSREVIADCIETCVQGQWMDGVVVVGGCDKNMPGGMIALARLNVPGIYVYGGTIRPGNWKGRDLTIVSSFEAVGEFTAGRMSQEDFEGVEKNACPTSGSCGGMYTANTMSSSFEALGMSLLYSSTMANPDQEKVDSAAESARMLVEAVKRDLKPRDIITKESIENAVSVIMATGGSTNAVLHYLAIAHAAEVDWTIDDFERIRKRVPVICDLKPSGQYVATDLHRAGGIPQVLKILLDAGLLHGDCMTITGRTIADELKDVPAVPRADQHVIFPIDRALYKEGHLAILKGNLAEDGAVAKITGLKNPVITGPARVFDDEQSAMDAILGDRIRAGDILVLRYLGPQGGPGMPEMLAPTSAIIGKGLGESVGFITDGRFSGGTWGMVVGHVAPEAFVGGTIALVQEGDSITIDAHRLLLQLNVDEAELARRRAAWRQPAPRYTRGVLAKFAALARPANQGAVTG

SEQ ID NO: 341 - DNA, 1686 bp, Burkholderia mallei
atggagttccccatgtcgtacaaccgccgctcgaagaacatcacgcaaggcgtggcccgttcgccgaaccgctcgatgtattacgcgctcggctatcagaaggaagatttcgacaagccgatgatcggcatcgcgaacggccactcgacgatcacgccgtgcaacgcgggcctgcagcgtctgtcggacgccgccgtcgcggccgtcaaggacgccggcgcgaatccgcagatcttcggcacgccgacgatctcggacggcatgtcgatgggcaccgaagggatgaagtactcgctcgtgtcgcgcgaggtgatcgccgattgcatcgagacctgcgtgcagggccaatggatggacggcgtcgtcgtcgtgggcggctgcgacaagaacatgccgggcggcatgatcgcgctcgcgcggatcaacgtgccgggcatctacgtgtacggcggcacgatccgccccggccactggaaaggccacgacctgacgatcgtgtcgtcgttcgaggcggtcggcgagttcaccgccggacgcatgtcgcaggaggatttcgaaggggtcgaaaagaacgcgtgcccgacgacgggctcgtgcggcggcatgtataccgcgaacacgatgagctcgtcgttcgaggcgctcggcatgtcgctgctgtactcgtcgacgatggccaatcccgatcaggagaaggtcgattcggcggcggaatcggcgcgcgtgctggtcgaggcggtgaagaaggacctgaagccgcgcgacatcatcacgaagcagtcgatcgagaacgcggtgtcggtcatcatggccacgggcggctcgaccaacgcggtgctccactatctggcgatcgcgcacgcggccgagatcgactggtcgatcgaggatttcgagcgcatcaggaagcgcgtgccggtgatttgcgacctgaagccgtcgggccagtacgtcgcgaccgatctgcacgcggcgggcggcattccgcaggtgatgaagctgctgctcgacgcgggcctgctgcacggcgactgcatgacgatcacgggccgcacgctcgccgaggagctgaaggacgtgccgagcgtgccgcgcgccgatcagaaggtgatccatccgatcgaccaggcgctgtacaaggaaggccacctcgcgatcctgaagggcaacctcgccgaggacggcgcggtcgcgaagatcaccggcctgaagaacccggtcatcaccggcccggcgcgcgtgttcgacgacgagcagagcgcgctcgccgcgatcctcgacgacaggatccgcgcgggcgacgtcgtcgtgctgcgctacctcggcccgcaaggcggcccggggatgcccgagatgctcgcgccgacatcggcgatcatcggcaagggcctcggcgaatcggtcggcctgatcaccgacggccgcttctccggcggcacgtgggggatggtggtcggccacgtcgcgccggaagcgttcgtcggcggcacgatcgcgctcgtgcaggaaggcgattcgatcacgatcgacgcgcacaagctgctgctgcaattgaacgtcgacgacgccgaactcgcgcgccgccgcgccgcatggaagcagccggcgccgcgctacacgcgcggcgtgctcgcgaagtacgcggcgctcgcccgcccggcgaaccagggcgccgtcacgggctga

SEQ ID NO: 342 - protein, 561 aa, Burkholderia mallei
MEFPMSYNRRSKNITQGVARSPNRSMYYALGYQKEDFDKPMIGIANGHSTITPCNAGLQRLSDAAVAAVKDAGANPQIFGTPTISDGMSMGTEGMKYSLVSREVIADCIETCVQGQWMDGVVVVGGCDKNMPGGMIALARINVPGIYVYGGTIRPGHWKGHDLTIVSSFEAVGEFTAGRMSQEDFEGVEKNACPTTGSCGGMYTANTMSSSFEALGMSLLYSSTMANPDQEKVDSAAESARVLVEAVKKDLKPRDIITKQSIENAVSVIMATGGSTNAVLHYLAIAHAAEIDWSIEDFERIRKRVPVICDLKPSGQYVATDLHAAGGIPQVMKLLLDAGLLHGDCMTITGRTLAEELKDVPSVPRADQKVIHPIDQALYKEGHLAILKGNLAEDGAVAKITGLKNPVITGPARVFDDEQSALAAILDDRIRAGDVVVLRYLGPQGGPGMPEMLAPTSAIIGKGLGESVGLITDGRFSGGTWGMVVGHVAPEAFVGGTIALVQEGDSITIDAHKLLLQLNVDDAELARRRAAWKQPAPRYTRGVLAKYAALARPANQGAVTG

SEQ ID NO: 343 - DNA, 1674 bp, Ralstonia eutropha
atggcattcaacaaacgctcccgcaacatcacgcaaggtgtggcgcgttccccgaaccgctcgatgtactacgccctgggctaccagaaggaagacttcgacaagcccatggtcggcatcgccaacggccactcgacgatcacgccgtgcaacgccggcctgcagcgcctggccgacgccgcgatcgacgccgtgaaggcctcggacgccaatccgcaggtattcggcacgccgacgatctccgacggcatgtcgatgggcaccgagggcatgaagtactcgctgatctcgcgcgaagtcattgccgactgcatcgagaccgccgcccagggccagtggatggacggcgtggtggtgatcggcggctgcgacaagaacatgccgggcggcatgatcgcgctcgcgcgcaccaatgtgccgggcatctacgtctatggcggcaccatcaagcccggcaactggaagggcaaggacctgaccatcgtgtcgtcgttcgaggccgtgggcgaattcaccgccggccgcatgagcgaagaagatttcgagggcgtggaaaggaacgcttgtccgtcgaccggatcgtgcggcggcatgtacaccgccaatacgatgagctcgtcgttcgaggcgcttgggatgtcgctgctgtattcgtcgacgatggccaaccccgatcaggaaaaggtcgatagcgctgccgaatcggcgcgcgtgctggtcgaggcgatcaagaaggacatcaagccgcgcgacatcatcacgcgcaagtcgatcgaaaacgccgtcgcgctgatcatggccaccggtggctcgaccaacgcggtgctgcactacctggccattgcgcactcggccgaagtcgaatggaccatcgacgatttcgagcgcatccgtcgcaaggtgcctgtgatctgcaacctgaagccgtcgggccagtacgtggccaccgacctgcacaaggcgggcggcatcccgcaggtcatgaagatcctgctgaaggccggactgctgcatggcgactgcctgaccatcacaggccgcacgctggctgaagagctggaacacgtgccggaccagccgcgggccgaccaggacgtgatcatgccaatcgagaaggcgctctatgcggaggggcatctggcgatcctgaagggcaatctcgccgaggaaggcgcggtggccaagatcaccggcctgaagaatccggtcatcaccgggccggcgcgggtgttcgaggatgaacagagcgcgatggaggcgatcctggccgacaagatcaatgcgggggatgtgctggtgctgcgctatcttgggcccaagggcgggcccgggatgccggaaatgctggcgcctacgtcagccattattggcaaggggttgggagagtcggtgggcttcatcaccgatggccggttctccgggggcacctgggggatggtcgtcggccatgtcgcgccggaagcgtatgtaggcggcaatattgcgctcgtgcgggaaggggattcgatcacgatcgatgcgcacaagctggtgttgcaggtgaatgtgtcggatgaggagttggctcgccgccgggctgagtggaaacaacctgttgcgcgttatacacggggggtattggccaagtttgctcgactggcgtcgacggccagtaagggggcggtgacggattga

SEQ ID NO: 344 - protein, 557 aa, Ralstonia eutropha
MAFNKRSRNITQGVARSPNRSMYYALGYQKEDFDKPMVGIANGHSTITPCNAGLQRLADAAIDAVKASDANPQVFGTPTISDGMSMGTEGMKYSLISREVIADCIETAAQGQWMDGVVVIGGCDKNMPGGMIALARTNVPGIYVYGGTIKPGNWKGKDLTIVSSFEAVGEFTAGRMSEEDFEGVERNACPSTGSCGGMYTANTMSSSFEALGMSLLYSSTMANPDQEKVDSAAESARVLVEAIKKDIKPRDIITRKSIENAVALIMATGGSTNAVLHYLAIAHSAEVEWTIDDFERIRRKVPVICNLKPSGQYVATDLHKAGGIPQVMKILLKAGLLHGDCLTITGRTLAEELEHVPDQPRADQDVIMPIEKALYAEGHLAILKGNLAEEGAVAKITGLKNPVITGPARVFEDEQSAMEAILADKINAGDVLVLRYLGPKGGPGMPEMLAPTSAIIGKGLGESVGFITDGRFSGGTWGMVVGHVAPEAYVGGNIALVREGDSITIDAHKLVLQVNVSDEELARRRAEWKQPVARYTRGVLAKFARLASTASKGAVTD

SEQ ID NO: 345 - DNA, 1674 bp, Ralstonia metallidurans
atggcttacaacaaacgttcccagcacatcacgcaaggcgtggcgcgctcccccaaccgttcgatgtactacgcgctcggctacaagaaggaagacttcgacaagccgatggtgggtatcgccaacggccactcgacgatcaccccctgcaacgccggcctgcagcgcctggcggacgcggccgtggatgcgatcaaggcctcggacgccaacccgcagatcttcggcacgccgacgatctccgacggcatgtcgatgggcaccgagggcatgaagtactcgctgatctcgcgtgaagtcattgccgactgcatcgaaaccgctgcccagggccagtggatggacggcgtggtcgtgatcggcggctgcgacaagaacatgcccggcggcatgatcgcactggcgcgcaccaacgtgccgggcatctacgtctacggcggcaccatccgcccgggtaactggaagggcaaggacctgaccatcgtgtcgtcgttcgaggccgtgggcgaattcaccgccggccgcatgagcgaggaagacttcgagggcgtggagaagaacgcctgcccgagcaccggctcgtgcggtggcatgtacaccgccaacacaatgagctcgtcgttcgaggcgctgggcatgtcgctgctgaattcgtcgacgatggccaacccggaccaggaaaaggtggacagcgccgccgaatcggcccgcgtgctggtggaagccatcaagaaggacatcaagccgcgcgacatcatcacgcgcaaatcgatcgagaacgccgtgacgctgatcatggccacgggcggttccaccaacgcggtactgcattacctggccatcgcccactcggccgaagtggaatggaccatcgacgatttcgagcgcatccgccgccgcgtgccggtgatctgcaacctgaagccgtcgggcgcctacgtggccaccgacctgcaccgcgccggtggcattccgcaagtgatgaagatcctgctgaacgccggtctgctgcatggcgactgcctgacgatcacgggccgcacgctggccgaggagctcgagcacgttcccaatgagccgcgtaccgaccaggacgtgatcctgccgatctcgcaggccctgtacaagcaaggccacctggccatcctgaagggcaacctcgccgaggaaggcgcagtggccaaaatcaccggcctgaagaacccggtcatcaccggcccggcccgcgtgttcgaggacgaacagagcgccatggaagcgatcctggcggacaagatcaacgctggcgacatcctggtgctgcgctaccttggcccgaagggcggcccgggcatgcctgaaatgctggcgccgacttcggcgatcatcggcaagggtctcggcgaatcggttggtttcatcaccgacggccgcttctcggggggcacctggggcatggtggttggccacgttgcgccggaagcccatgtgggcggtacgattgcactggttcaggaaggcgactcgatcacgatcgacgcgcaccagctgctgctgcaactgaatgtggccgacgacgagctggcccgccgccgcgctgcctggaaacagccggcgccgcgctacacgcgcggcgtactggcgaagttcgcgaggctggcctccacggccagcaagggcgccgtgacggactga

SEQ ID NO: 346 - protein, 557 aa, Ralstonia metallidurans
MAYNKRSQHITQGVARSPNRSMYYALGYKKEDFDKPMVGIANGHSTITPCNAGLQRLADAAVDAIKASDANPQIFGTPTISDGMSMGTEGMKYSLISREVIADCIETAAQGQWMDGVVVIGGCDKNMPGGMIALARTNVPGIYVYGGTIRPGNWKGKDLTIVSSFEAVGEFTAGRMSEEDFEGVEKNACPSTGSCGGMYTANTMSSSFEALGMSLLNSSTMANPDQEKVDSAAESARVLVEAIKKDIKPRDIITRKSIENAVTLIMATGGSTNAVLHYLAIAHSAEVEWTIDDFERIRRRVPVICNLKPSGAYVATDLHRAGGIPQVMKILLNAGLLHGDCLTITGRTLAEELEHVPNEPRTDQDVILPISQALYKQGHLAILKGNLAEEGAVAKITGLKNPVITGPARVFEDEQSAMEAILADKINAGDILVLRYLGPKGGPGMPEMLAPTSAIIGKGLGESVGFITDGRFSGGTWGMVVGHVAPEAHVGGTIALVQEGDSITIDAHQLLLQLNVADDELARRRAAWKQPAPRYTRGVLAKFARLASTASKGAVTD

SEQ ID NO: 347 - DNA, 1674 bp, Ralstonia solanacearum
atgccagacaacaagcgttcccagcacatcacccagggcgtggcacgctcgcccaaccgctcgatgtactacgcgctgggctaccagaaagaagacttcaacaatccgatgatcggcgtggccaacggccattcgaccatcacgccgtgcaactcgggcctgcagaaactggccgacgcggccgtggccgccgtcaaggcatcgaacgccaacccgcagatcttcggcacgcccaccatttccgacggcatgtcgatgggcaccgagggcatgaagtattcgctgatctcgcgcgaggtcatcgccgactgcatcgagacctgcgcacaaggccagtggatggacggcgtggtcgtgatcggcggctgcgacaagaacatgcccggcggcatgatcgcgctggcacgcaccaacgtgccgggcatctacgtgtacggcggcaccatccggccggggcactggaagggcaaggacctgaccatcgtgtcgtcgttcgaggccgtgggcgagttcaccgccggccgcatgagcgacgaagacttcgagggcatcgagaagaacgcctgcccgtcgagcggctcgtgcggcggcatgtacaccgccaacacgatgagctcgtcgttcgaggcgctgggcatgtcgctgctgtattcgtcgaccatggccaaccccgaccaggagaaggtcgacagcgccgccgaatcggcccgcgtgctggtcgaggccgtgcgccgcgacctcaagccgcgcgacatcatcacgcgcaagtcgatcgagaacgccgtggccgtcatcatggcgaccggcggctcgaccaacgccgtgctgcactacctggccatcgcccatgccgccggcgtggaatggaccatcgatgacttcgagcgcgtgcgccagcgcgtgcccgtgatctgcaacctgaagccgtcgggccagtatgtcgccaccgacctgcaccgcgcgggcggcatcccgcaggtgatgaagatcctgctgaacgcgggcctgctgcacggcgactgcatcaccatcaccggcaagacgctggccgaggaactcgccaacgtgcccgaccagccgcgcgcggaccaggacgtgatcctgccgctcgacaaggcgctctaccagcagggccacctcgccatcctcaagggcaacttggccgaggaaggcgccgtggcgaagatcaccggcctgaagaacccggtcatcaccggcccggcgcgcgtgttcgacgatgagcagagcgcgatggaagccatcctgggcgacaaaatcaacgccggcgacgtgctggtgctgcgctacctcggtccgaagggcggcccgggcatgccggaaatgctggccccgacgtcggccatcatcggcaagggcctgggcgaatcggtcggcttcatcaccgatggacgcttctcgggcggcacctggggcatggtggtcggccacgtcgcgccggaagccttcgtgggcggcaccatcgccctggtgcaggaaggcgattcgatcaccatcgacgcgcaccagcgcgtgctgcagctgaacgtgccggaagacgaactggcccgccgccgcgccgcgtggcagcagccggcaccgcgctatacgcgcggcgtgctcgccaagttcgctcagttggcgtcgacggccagcaagggcgccgtgaccggctga

SEQ ID NO: 348 - protein, 557 aa, Ralstonia solanacearum
MPDNKRSQHITQGVARSPNRSMYYALGYQKEDFNNPMIGVANGHSTITPCNSGLQKLADAAVAAVKASNANPQIFGTPTISDGMSMGTEGMKYSLISREVIADCIETCAQGQWMDGVVVIGGCDKNMPGGMIALARTNVPGIYVYGGTIRPGHWKGKDLTIVSSFEAVGEFTAGRMSDEDFEGIEKNACPSSGSCGGMYTANTMSSSFEALGMSLLYSSTMANPDQEKVDSAAESARVLVEAVRRDLKPRDIITRKSIENAVAVIMATGGSTNAVLHYLAIAHAAGVEWTIDDFERVRQRVPVICNLKPSGQYVATDLHRAGGIPQVMKILLNAGLLHGDCITITGKTLAEELANVPDQPRADQDVILPLDKALYQQGHLAILKGNLAEEGAVAKITGLKNPVITGPARVFDDEQSAMEAILGDKINAGDVLVLRYLGPKGGPGMPEMLAPTSAIIGKGLGESVGFITDGRFSGGTWGMVVGHVAPEAFVGGTIALVQEGDSITIDAHQRVLQLNVPEDELARRRAAWQQPAPRYTRGVLAKFAQLASTASKGAVTG

SEQ ID NO: 349 - DNA, 1674 bp, Ralstonia pickettii
atgccagacaacaagcgttcccagcacatcactcagggcgtggcgcgctcgcccaaccgctcgatgtactacgcgctgggctacacaaaagacgacttcaacaatccgatgatcggtgtggccaacggccattcgaccatcacgccatgcaactcgggcctgcagaagctggccgatgccgccgtggctgcaataaaggacgcccgcgcgaatccgcagatcttcggcacgcccaccatttccgatggcatgtcgatgggcacggaaggcatgaagttctcgctgatctcgcgcgaagtgattgccgactgcatcgagacctgcgtcaacggccaatggatggacggtgtggtcgtcatcggcggctgcgacaagaacatgccgggcggcatgatcgccctggcgcgcacgaatgtgccgggcatctacgtgtacggcggcaccatcaagccggggcactggaagggcaaggacctgaccatcgtctcgtcgttcgaggccgtgggcgaattcaccgccggccgcatgagcgaggaagacttcgagggcatcgaaaaaaacgcctgcccgtcgagcggttcgtgcggcggcatgtacacggccaacacgatgagttcgtcgtttgaagcgctaggcatgtcgttgctgtattcatcgacgatggccaatcccgatcaggagaaggtcgacagcgccgccgaatccgctcgcgtgttggttgatgccgtgcgccgcgacctgaagccgcgcgacatcatcacgcgcaagtccatcgagaacgctgtcgccgtcatcatggcaaccggtggctcgaccaacgccgtgctgcactacctggccatcgctcacgctgcggaagtggaatggacgatcgacgacttcgagcgggtgcgccagcgcgtgcccgtcatctgcaacctcaagccgtcgggccagtacgtggccaccgacctgcacgaggccggcggcatcccgcaggtgatgaagctgctgctcaacgccggcctgctgcatggcgattgcatcaccatcaccggcaagacgctggcggaagaactcgcccacgtgcccgaccagccgcgcgctgatcagaacgtgatcctgccgattgacaaggcgctctacaaggaaggccacctcgccatcctgaagggcaatctggccgaagaaggcgccgtggcgaagatcaccgggctgaagaatcccgtcatcaccggcccggcccgcgtgttcgaggacgagcaaagtgcgatgagcgcgatcctgggcgaccagatcaaggccggcgatattctggtgctgcgctatctggggccgaagggcggccccggcatgccggagatgctggccccgacctcggccatcatcggcaagggcctgggcgagtcagtcggcttcattaccgacggacgcttctcgggcggtacgtggggcatggtggtcggccacgtcgcaccggaagcctacgtgggaggcacgattggattggtgcacgaaggggattcgatcaccatcgacgcgcaccagcggctgctgcaattgaacgtgccggacgacgagcttgcccgccgccgcgccgcgtggaagcaacctgcgccgcgctatacgcgtggcgtgctggcgaagtttgcaaaactggcagcaacggccagcaagggtgcggtaacggactga

SEQ ID NO: 350 - protein, 557 aa, Ralstonia pickettii
MPDNKRSQHITQGVARSPNRSMYYALGYTKDDFNNPMIGVANGHSTITPCNSGLQKLADAAVAAIKDARANPQIFGTPTISDGMSMGTEGMKFSLISREVIADCIETCVNGQWMDGVVVIGGCDKNMPGGMIALARTNVPGIYVYGGTIKPGHWKGKDLTIVSSFEAVGEFTAGRMSEEDFEGIEKNACPSSGSCGGMYTANTMSSSFEALGMSLLYSSTMANPDQEKVDSAAESARVLVDAVRRDLKPRDIITRKSIENAVAVIMATGGSTNAVLHYLAIAHAAEVEWTIDDFERVRQRVPVICNLKPSGQYVATDLHEAGGIPQVMKLLLNAGLLHGDCITITGKTLAEELAHVPDQPRADQNVILPIDKALYKEGHLAILKGNLAEEGAVAKITGLKNPVITGPARVFEDEQSAMSAILGDQIKAGDILVLRYLGPKGGPGMPEMLAPTSAIIGKGLGESVGFITDGRFSGGTWGMVVGHVAPEAYVGGTIGLVHEGDSITIDAHQRLLQLNVPDDELARRRAAWKQPAPRYTRGVLAKFAKLAATASKGAVTD

SEQ ID NO: 351 - DNA, 1689 bp, Limnobacter sp.
atgagcatcaatcgacgttccaagaacattacccagggcgtggcccgttcgcccaaccgcgcgatgtatttcgccatgggttacaaagacgaagacttcaataaccccatgattggcattgccaatggccattccacgatcacgccttgcaacagcggcttgcagcctttggcagatgcggctgtgaaagcagtgaaagaggctggtggcaatccacaaattttcggcacccccaccatctccgatggcatgagcatgggcaccgaaggcatgaagtattcactggtcagccgcgaggtcatcgcggactgcatcgaaactgcggtacagggccagtggatggacggcgtgttggtgatcggcggctgcgacaagaacatgcccggcggcatgatcggcatggcccgcatgaacgtgccaggcatttacgtttatggcggcactatcaagccggggcgttacaaaggcaaagacctgaccattgtgtctgccttcgaagccgtgggcgaattcacggctggccgcatgagcgaggaagacttcaagggtatagagaagaacgcctgcccgagttccggttcctgtggtggcatgtacaccgccaacaccatgagctcggcattcgaagctttgggcatgagcctgccctactccagcaccatgtcgaacattgacgcagagaaagtcacttcaactgaagagtccgctcgcgtcttgatcgaagcggttcgcaacgacttgaagccccgcgacatcatcaccaagaagtcgattgaaaatgctgtggccgtgctgatggccaccggtggttccaccaacgcggtactgcacttcctggccattgcaaaagcagcagatgtggcctggagctacgaagactttgaacgcgtgcgcttgcgcacaccagtcatttgcaacctgaagccttctggccaatacgttgccactgacctgcacgatgccggtggtattccacaagtcatgaaaattttgttggatgcgggcctgttgcatggcgattgcatcaccatcactggcaaaaccattgcagaaaccctggccgatattccttcagtgccccgcgcggatcaaaacgtgatcatgccgatcgaaaaagccctgtacaagcaaggccacttggcgattctgaaaggcaacctggcacccgaaggtgctgtggccaagatcacaggcctcaaaaaccctgtaattaccggaccagccaaggtttttgacgacgagcaaagcgcgatggacgcaattttgggcgacaagatcaaagacggcgacgtgattattcttcgctacttgggccccaaaggcggtccaggcatgccggaaatgttggccccaacctcggcaattattggcaagggcttgggagaaacagtcggcctgatcaccgacggccgcttttccggtggcacctggggtatggtggtcggccacgttgcgccagaggcctacgttggcggcccgatcgcgctgatcaaggaaggtgactccatcacgatggacgcacatcagaaattgttacagatcaacgtgagcgaggaagaactggcgaagcgtcgtgaaagttgggtaaaacccaagccacgctacaccactggtgtgctggccaaattcgcagccttggccagtagcgccagcaagggtgcagtcaccgatggcgatctcgacctctaa

SEQ ID NO: 352 - protein, 562 aa, Limnobacter sp.
MSINRRSKNITQGVARSPNRAMYFAMGYKDEDFNNPMIGIANGHSTITPCNSGLQPLADAAVKAVKEAGGNPQIFGTPTISDGMSMGTEGMKYSLVSREVIADCIETAVQGQWMDGVLVIGGCDKNMPGGMIGMARMNVPGIYVYGGTIKPGRYKGKDLTIVSAFEAVGEFTAGRMSEEDFKGIEKNACPSSGSCGGMYTANTMSSAFEALGMSLPYSSTMSNIDAEKVTSTEESARVLIEAVRNDLKPRDIITKKSIENAVAVLMATGGSTNAVLHFLAIAKAADVAWSYEDFERVRLRTPVICNLKPSGQYVATDLHDAGGIPQVMKILLDAGLLHGDCITITGKTIAETLADIPSVPRADQNVIMPIEKALYKQGHLAILKGNLAPEGAVAKITGLKNPVITGPAKVFDDEQSAMDAILGDKIKDGDVIILRYLGPKGGPGMPEMLAPTSAIIGKGLGETVGLITDGRFSGGTWGMVVGHVAPEAYVGGPIALIKEGDSITMDAHQKLLQINVSEEELAKRRESWVKPKPRYTTGVLAKFAALASSASKGAVTDGDLDL

SEQ ID NO: 353 - DNA, 1674 bp, Herminiimonas arsenicoxydans
atggcattcaatcgccgctcgaaaaacatcacgcaaggcgtgtcccgcagtcctaaccgttccatgtattacgccatgggttacgaaaaggccgatttcgacaagcctatggtcggcatcgccaacggtcactcgacgattacgccatgtaactccggcctgcaaaaactggccgatatcgcgatcaagaccatcaaggatgcaggcggcaatccgcaagtgttcggtacgccgacgatttccgacggcatgtccatgggcaccgaaggcatgaagtattcgctgatttcgcgcgaagtcattgccgactgtatcgaaaccgcagtcaacggccaatggatggatggcgtgctggtcatcggcggctgcgacaagaatatgccgggcggcatgatcgccatgttgcgcaccaacgtgcctagtatttatgtctacggcggcaccatcaagccggggcactggaaaggcaaagacctgaccatcgtttccgcgtttgaagcggtcggcgaattcactgccggccgcatgtcacaagaagattttgacggcatcgaacgcaatgcctgcccatcatccggttcctgcggcggcatgtatacagccaataccatgtcgtcctcgttcgaggcgctgggcctggccttgccttactcgtcgacgatggccaatcctgacgatgaaaaagtcggctccgcagcggaatccgcgcgcgtgctgatcgaagcaatcaagaaggatctgaagccgcgcgacatcgtgacacgcaaggctatcgaaaacgcagtggccgtcatcatggcaaccggcggttcgaccaatgccgtgctgcacttcctggcgattgcgcacgctgcagaaatcgactggaccatcgacgacttcgaacgcatgcgcaaaaaagtccctgtcatctgcgatctgaaaccatccggcaaatacgtggcaaccgatctgcataaggccggcggcattccgcaagtgatgaaggtgttgctcgacgccggcttgttgcacggtgattgcatgacgatcaccggccagaccgttgcagaagcgctggcgcacatcccgtcggtaccaagtgccgaccaggacgtgatccacaccatcgacaaggctttgtacgcacaaggtcaccttgcaatcctgaagggcaatctgtcgcctgaaggttgcgtggcaaaaatcaccggtctgaaaaatcctgtcatcaccggacctgcacgcgtatttgacgacgaatactcggcaatggacgccatcatggcgaaccagatcaaggccggcgacgtactcgtcatgcgctacctcggacctaaaggcggcccgggcatgccggaaatgctggcaccgacttccgcactggtcggtcagggtctgggtgagtcagtcggcttgattaccgatggccgtttctccggcggtacctggggcatggtggttggccacgtttcgccggaagcgtttgtcggcggtaccatcggtctggtggaagaaggcgattccgtcaccatcgatgcgcgtcaattgctgattcagttgaacgtatcggaagaggaaatcgcacgccgtcgcgccaactggaagcagcctgcaccgcgttacacacgtggcgtgctggcaaaatatgcagctctggcatcgacggcaagcaaaggcgctgtcaccggctga

SEQ ID NO: 354 - protein, 557 aa, Herminiimonas arsenicoxydans
MAFNRRSKNITQGVSRSPNRSMYYAMGYEKADFDKPMVGIANGHSTITPCNSGLQKLADIAIKTIKDAGGNPQVFGTPTISDGMSMGTEGMKYSLISREVIADCIETAVNGQWMDGVLVIGGCDKNMPGGMIAMLRTNVPSIYVYGGTIKPGHWKGKDLTIVSAFEAVGEFTAGRMSQEDFDGIERNACPSSGSCGGMYTANTMSSSFEALGLALPYSSTMANPDDEKVGSAAESARVLIEAIKKDLKPRDIVTRKAIENAVAVIMATGGSTNAVLHFLAIAHAAEIDWTIDDFERMRKKVPVICDLKPSGKYVATDLHKAGGIPQVMKVLLDAGLLHGDCMTITGQTVAEALAHIPSVPSADQDVIHTIDKALYAQGHLAILKGNLSPEGCVAKITGLKNPVITGPARVFDDEYSAMDAIMANQIKAGDVLVMRYLGPKGGPGMPEMLAPTSALVGQGLGESVGLITDGRFSGGTWGMVVGHVSPEAFVGGTIGLVEEGDSVTIDARQLLIQLNVSEEEIARRRANWKQPAPRYTRGVLAKYAALASTASKGAVTG

SEQ ID NO: 355 - DNA, 1785 bp, Bordetella parapertussis
atgtccgataataaccggcgagcgtgttgttccgtagcgctgccttccgacagcgatctggccggcccggcatgggcctacgcacctggagacaagaccatgtccgacaacaatcgttcccgtcacattaccgagggcgtggcgcgcgcgcccaatcgggccatgtactacgcgctgggctacaccgaggcggatttccagaatccgatgatcggcgtggccaacggacattccacgatcactccatgcaacagcgggctgcagcgcctggccgacgcggcgatcgaggccatccgcgtctcccgcgccaacccccaggtgttcggcacgccgacgatttccgatggcatgtccatgggcaccgaaggaatgaagtattcgctggtgttgcgcgaggtcatcgccgactgcatcgagaccgccgcgcaggggcagtggatggatggcgtggtggtcatcggcggatgcgacaagaacatgcccggcggcatgatggcgctcgcgcgcatgaatgtgcccggcatctacgtgtatggcggcaccatcaagcccggccactacaagggcaaggacctgaccatcgtatcggtgttcgaagccgtcggcgaatacaccatgggccgcatggacgaaaccgacttcaaggccatcgagcaatgcgccatccccgggtcgggttcctgcggcggcatgtacacggccaacaccatgagctcggccttcgaggccatggggatgagcctgcctcattccagcaccatggccaacgaggaccaggagaaagtcgcgtcggcggcggaatcggcgcgcgtgctggtcgaggcggtgcggcgccagctgcggccgcgcgacatcatcacccgcgcttccatcgagaacgccgtggcggtgatcatggccacgggcggctcgaccaacgccgtgctgcacttcctcgccatcgcccacgcggcggaagtgccgtggaacatcgacgacttcgagcgcatccgcaagcgcgtgccggtcatctgcgatctcaagccgtccggcaagtacgtggcgaccgacctgcatcgcgccggcggcatcccacaagtgatgaagatcctgctgaacgccggcctgttgcatggcgattgcatcaccatcaccggcaagaccgtggccgagacgctggcgaacgtacccgatgcgccgccgcccgggcaggacgtcatcatgcccatcgaacgcgcgttctacccgcaggggcacctggcgatactcaagggcaatctttcgccggaaggctgcgtggccaagatcaccgggttgaagaatccggtcattaccggcccggcgcgcgtgttcgattccgaagacgatgccatgtccgccatcatggaccgccgcatccgcgatggcgatgtggtggtgatccgctacgagggccccaagggcggtccaggcatgcgcgagatgctcgcgcccacttccgcgctggtcggccaggggttgggcgaaaccgtcggcctgatcaccgacgggcggttttccggcggcacctggggcatggtggtcgggcacgtggcgcccgaggcgttcgtcggcgggccgatcgcgctgattcgcgagggcgattcggttaccatcgatgcccatcagctgctgctgcagctcaacatcagcgatgaggaaatggcggctcgtcgcaaggcttgggcccagcccaagccgcgctatgtgcgcggcgtgcttgccaagttcggcaagctggcctgtaccgccagccgtggggcagtaaccgatgcatttgaagagtag

SEQ ID NO: 356 - protein, 594 aa, Bordetella parapertussis
MSDNNRRACCSVALPSDSDLAGPAWAYAPGDKTMSDNNRSRHITEGVARAPNRAMYYALGYTEADFQNPMIGVANGHSTITPCNSGLQRLADAAIEAIRVSRANPQVFGTPTISDGMSMGTEGMKYSLVLREVIADCIETAAQGQWMDGVVVIGGCDKNMPGGMMALARMNVPGIYVYGGTIKPGHYKGKDLTIVSVFEAVGEYTMGRMDETDFKAIEQCAIPGSGSCGGMYTANTMSSAFEAMGMSLPHSSTMANEDQEKVASAAESARVLVEAVRRQLRPRDIITRASIENAVAVIMATGGSTNAVLHFLAIAHAAEVPWNIDDFERIRKRVPVICDLKPSGKYVATDLHRAGGIPQVMKILLNAGLLHGDCITITGKTVAETLANVPDAPPPGQDVIMPIERAFYPQGHLAILKGNLSPEGCVAKITGLKNPVITGPARVFDSEDDAMSAIMDRRIRDGDVVVIRYEGPKGGPGMREMLAPTSALVGQGLGETVGLITDGRFSGGTWGMVVGHVAPEAFVGGPIALIREGDSVTIDAHQLLLQLNISDEEMAARRKAWAQPKPRYVRGVLAKFGKLACTASRGAVTDAFEE

SEQ ID NO: 357 - DNA, 1686 bp, Bordetella petrii
atgcccagcaacgaacgttcacgccacatcacgcaaggcgtcgcccgcgcgcccaaccgggccatgtattacgcgctgggctaccaggaagccgatttcgacaaccccatgatcggcgtggccaacggccattccaccatcaccccctgcaacagcggcctgcagcggctggccgacgcggccatcgatgccgtgcgcgcggcccgcgccaatccgcaggtgttcggcacccccaccatatccgacggcatgtcgatgggcaccgagggcatgaaatactcgctggtgtcgcgcgaagtcattgccgactgtatcgagaccgccgtgcagggccagtggatggacggcgtcgtggtcatcggcggctgcgacaagaacatgcccggcggcatgatcgcgctggcccgcatgaacgtgccaggcatctacgtgtatggcggcaccatcaagccgggccgctataaagggcaagatctcactatcgtgtccgtgttcgaagccgtcggtgagtacaccatggggcgcatggacggcgaagatttccgccagatcgaaaaatgcgccattcccggctcgggctcgtgcggcggcatgtacaccgccaacaccatgagttcggccttcgaagccatgggcatgagcctgccgtattccagcaccatggccaacgaagacgacgaaaaaatcgcctcggccgccgagtccgcccgcgtgctggtcgatgccgtgcggcgcgacgtgcggccgcgcgacatcatcacgcgcgaatccatcgaaaacgccgtgtcggtcatcatggccacgggcggctccaccaatgccgtgctccatttcctggccatcgcccacgccgccgaagttcaatggaccatcgacgacttcgagcgcatccgccggcgcgtgccggtcatctgcgacctcaaaccttcgggccgatacgtggccaccgatctgcaccgcgccggcggcgtcccgcaagtcatgaagctgctgctcgctgccggcttgctgcatgggcattgcatgaccatcaccggcaagaccatcgccgaaacgctcgccgacgtgcccgccgagccgccggccggccaggatgtcatccggcctatcggccgcgcgctgtacccgcagggccatctggccatcctcaagggcaacctgtcgcccgagggctgcgtggccaagatcacgggcctgaagaatcccgtcatcaccggcccggcgcgcgtgttcgattcagaagacgacgccatggccgccatcatggaacggcgcattcgcgctggcgacgtggtggtcatccgctacgaagggcccaagggcggtcccggcatgcgcgaaatgctggcgcccacctcggcgctggtggggcagggcctgggcgaaagcgtcggcctcattaccgatggccgcttctcgggcggcacctggggcatggtcgtgggccatgtcgcgcccgaggcctatgtgggcggccccattgccctgatccgcgaaggcgattcggttaccatcgacgctcaccaattgttgttgcagctcaatatttctgacgacgaaatggcggcgcgccgcaaggcctgggtccagccccggccgcggtacacgcgcggcgtgcttgccaagttcggcaagctggccggcaccgccagtcgcggggcagttaccgatgcatttgaagcatag

SEQ ID NO: 358 - protein, 561 aa, Bordetella petrii
MPSNERSRHITQGVARAPNRAMYYALGYQEADFDNPMIGVANGHSTITPCNSGLQRLADAAIDAVRAARANPQVFGTPTISDGMSMGTEGMKYSLVSREVIADCIETAVQGQWMDGVVVIGGCDKNMPGGMIALARMNVPGIYVYGGTIKPGRYKGQDLTIVSVFEAVGEYTMGRMDGEDFRQIEKCAIPGSGSCGGMYTANTMSSAFEAMGMSLPYSSTMANEDDEKIASAAESARVLVDAVRRDVRPRDIITRESIENAVSVIMATGGSTNAVLHFLAIAHAAEVQWTIDDFERIRRRVPVICDLKPSGRYVATDLHRAGGVPQVMKLLLAAGLLHGHCMTITGKTIAETLADVPAEPPAGQDVIRPIGRALYPQGHLAILKGNLSPEGCVAKITGLKNPVITGPARVFDSEDDAMAAIMERRIRAGDVVVIRYEGPKGGPGMREMLAPTSALVGQGLGESVGLITDGRFSGGTWGMVVGHVAPEAYVGGPIALIREGDSVTIDAHQLLLQLNISDDEMAARRKAWVQPRPRYTRGVLAKFGKLAGTASRGAVTDAFEA

SEQ ID NO: 359 - DNA, 1695 bp, Polaromonas sp.
atggaaaccaagaccattcagctcaacccccgcagcaaaaacatcaccgaaggcaaatcgcgcgcgcccaaccgctcgatgtactacgccatgggctatgaagaggccgacttcaagaagcccatgattggtgtggccaacgggcacagcaccatcaccccctgcaacagcggcctgcaaaagctggcggacgcggccattgccggcattgaagaagccggcggcaacgcccaggtgttcggcacgcccaccatctcggacggcatggccatgggcaccgagggcatgaagtactcgctggtcagccgcgaagtgatctccgactgcatcgaaacctgcgtgcagggccagtggatggacggcgtgctggtgatcggcggctgcgacaagaacatgcccggcggcctgatgggcatgctgcgcgccaacgtgccggccatctacgtctatggcggtaccattttgccgggcagctacaagggcaaagacctcaacatcgtcagcgtgtttgaagccgtcggcgaaaacgcagcaggccgcatgagcgatgaagacctgctgcaaatcgagcgccgcgccattcccggcaccggtagctgcggcggcatgtacacggccaacaccatgtccagcgccttcgaggcgctcggcatttcgctgccctactccagcaccatggccaatccgcacgacgagaaaatgaactcggccagggagtccgccaaggtcctggtcgaagccatcaagaaagacatcaagccgcgcgatctcgtcacgaagaaagccattgaaaacgccgtggcagtgatcatggccacgggcggctccaccaatgccgtgctgcacttcctggcgattgcgcatgccgccggcgtggactggacaatcgacgacttcgaacgcgtgcgccaaagaacgccggtgctgtgcgacctgaagccgtccggcaagtacctggccgtggacctgcaccgcgccggcggcattccgcaggtcatgaagatgctgctggcggccggcctgctgcatggcgactgcctgacgatcaccggccaaaccattgccgaggtgctgaaggatgtgcccgaagcgccgcgcgccgaccaggacgtgattcgccccatcagcaaccccatgtacgcccagggccacctggccatcctgaagggcaacctctcgcctgaaggctgcgtggccaaaatcaccggcctgaaaaacccggtcatgacgggcccggcccgcgtatttgacgacgagcagtcggcgctggccgccatcctggccggcaagatcaaggcgggcgacgtgatggtgctgcgttacctcggccccaagggcggtcccggcatgcctgaaatgctggcgcctaccggtgcgctgattggcgccggcctgggcgaaagcgtgggcctgatcaccgacggccgcttctccggcggcacctggggcatggtagtcggccatgtggcccccgaagcggccgccggcggcaatatcgcattcatcaacgaaggcgactccatcaccattgactcaaaacagttgctgctgcaactgaacatcagcgacgcggagctggaaaaacgcaaggtcggctggaaagcaccggcaccgcgctacaaccgcggcgtgcaggccaagtttgccttcaacgcgtcgagtgccagcaagggtgcggtgctggacgactattga

SEQ ID NO: 360 - protein, 564 aa, Polaromonas sp.
METKTIQLNPRSKNITEGKSRAPNRSMYYAMGYEEADFKKPMIGVANGHSTITPCNSGLQKLADAAIAGIEEAGGNAQVFGTPTISDGMAMGTEGMKYSLVSREVISDCIETCVQGQWMDGVLVIGGCDKNMPGGLMGMLRANVPAIYVYGGTILPGSYKGKDLNIVSVFEAVGENAAGRMSDEDLLQIERRAIPGTGSCGGMYTANTMSSAFEALGISLPYSSTMANPHDEKMNSARESAKVLVEAIKKDIKPRDLVTKKAIENAVAVIMATGGSTNAVLHFLAIAHAAGVDWTIDDFERVRQRTPVLCDLKPSGKYLAVDLHRAGGIPQVMKMLLAAGLLHGDCLTITGQTIAEVLKDVPEAPRADQDVIRPISNPMYAQGHLAILKGNLSPEGCVAKITGLKNPVMTGPARVFDDEQSALAAILAGKIKAGDVMVLRYLGPKGGPGMPEMLAPTGALIGAGLGESVGLITDGRFSGGTWGMVVGHVAPEAAAGGNIAFINEGDSITIDSKQLLLQLNISDAELEKRKVGWKAPAPRYNRGVQAKFAFNASSASKGAVLDDY

SEQ ID NO: 361 - DNA, 1695 bp, Polaromonas naphthalenivorans
atggaaaccaaagtcatcgccatcaaccgccgctcggccaacatcaccgagggcaagtcgcgcgcgcccaaccgctccatgtactacgccatgggctacgaggaaagcgatttcaagaaacccatgatcggcgtggccaacggccacagcaccatcacgccgtgcaacagcggcctgcaaaagctggcggacgcggcgattgacgcgattgaggaagccggcggcaatgcgcaggtgttcggcacgccgacgatttcggacggcatggccatgggcaccgaaggcatgaagtattcgctggtcagccgcgaagtcatttcggactgcatcgaaacctgcgtgcagggccagtggatggacggcgtgctggtggtcggcggctgcgacaagaacatgcccggcggcctgatgggcatgctgcgcgccaacgtgccggcgatttttgtctatggcggcacgatcttgccaggccattaccagggcaaagacctgaacatcgtcagcgtgttcgaagccgtcggtgaaaacgccgccggccgcatgagcgacgaagacctgctgcagattgagcgtcgcgccattcccggcaccggcagctgcggcggcatgtacaccgccaacaccatgtccagcgccttcgaggccctgggcatttcgctgccctactccagcaccatggccaatccgcatgacgaaaagctgaactcggcgaaggaatcggcccgggtgctgatcgaagcggtcaagaaagacatcaagccgcgcgacatcgtcaccaagaaatccattgaaaacgccgtggccgtcatcatggccaccggcggctcgaccaatgccgtgctgcatttcctggccatcgcccatgcggccggcgtcgaatggacgattgacgacttcgagcgcgtgcgccagaaaaccccggtgctgtgcaacctgaaaccctcgggccagtacctggcggtggacctgcaccaggccggcggcattccgcaggtcatgaaaatgctgctggtcgccggcctgctgcatggcgactgcatcaccatttcgggccagaccattgccgaagtgcttgcggacgtgcccgatgcgccgcgcgccggccaggacgtgatccgccccatcgaccagccgatgtatgcgcagggccacctggccatcctcaagggcaacctctcgcccgaaggctgcgtggccaagatcaccggcttgaagaacccggtcatgaccggcccggcccgggtgtttgaggacgagcagtccggcctgaaggcgattctggacggcaagatcgtggccggtgacgtgatggtgctgcgctacctcggccccaagggcggtcccggcatgcctgaaatgctggccccgaccggcgcgctgattggcgccggcctgggcgagagcgtcggcctgatcaccgacgggcgcttttccggcggcacctggggcatggtggtcggccatgtggcgccggaagcggcggccggcggcaatatcgccttcatcgaggaaggcgactcgatcacgattgacgccaatcagctgctgctgcaactgaacatcagcgacgccgagcttgaaagccgcaaggtcggctggacggccccggccccgcgttacacccgtggcgtgcaggccaagttcgccttcaatgcctccagcgccagcaagggcgcggtgcttgatgactattga

SEQ ID NO: 362 - protein, 564 aa, Polaromonas naphthalenivorans
METKVIAINRRSANITEGKSRAPNRSMYYAMGYEESDFKKPMIGVANGHSTITPCNSGLQKLADAAIDAIEEAGGNAQVFGTPTISDGMAMGTEGMKYSLVSREVISDCIETCVQGQWMDGVLVVGGCDKNMPGGLMGMLRANVPAIFVYGGTILPGHYQGKDLNIVSVFEAVGENAAGRMSDEDLLQIERRAIPGTGSCGGMYTANTMSSAFEALGISLPYSSTMANPHDEKLNSAKESARVLIEAVKKDIKPRDIVTKKSIENAVAVIMATGGSTNAVLHFLAIAHAAGVEWTIDDFERVRQKTPVLCNLKPSGQYLAVDLHQAGGIPQVMKMLLVAGLLHGDCITISGQTIAEVLADVPDAPRAGQDVIRPIDQPMYAQGHLAILKGNLSPEGCVAKITGLKNPVMTGPARVFEDEQSGLKAILDGKIVAGDVMVLRYLGPKGGPGMPEMLAPTGALIGAGLGESVGLITDGRFSGGTWGMVVGHVAPEAAAGGNIAFIEEGDSITIDANQLLLQLNISDAELESRKVGWTAPAPRYTRGVQAKFAFNASSASKGAVLDDY

SEQ ID NO: 363 - DNA, 1695 bp, Rhodoferax ferrireducens
atggacatcaaaccagtcatcctgaacccacgcagcaaaaacatcaccgagggcaaatcgcgggcgcccaatcgctccatgtactacgccatgggctacgaggccgacgacttcaagaagcccatgatcggtgtcgccaacggccacagcaccatcacaccgtgcaactccggcctgcaaaagctggccgatgccgccattgccgcgattgaagaagccggcggcaacgcccaggtgttcggcacccccaccatttccgacggcatgtcgatgggcaccgagggcatgaagtattcgctggtcagccgcgaagtaatttccgactgtattgagacctgcgtgcagggccagtggatggacggtgtgctggtgatcggcggttgcgacaaaaacatgcccggcggcctgatgggcatgctgcgcgccaatgtgcccgcgatttatgtctacggcggcaccattttgccgggccattacaagggccaggacctcaacatcgtgagcgtgttcgaggccgtgggcgagaacgccgcaggtcgcatgagcgacgaagatctgttggagattgagcgccgcgccatccctggccccggctcttgcggcggcatgtacaccgccaacaccatgagttcggcctttgaggcactgggcatctccctggtctactcgtccaccatggccaatccgcatgacgagaagctgaattcggcccaagaatcagccaaggtgctgattgaagccatcaagaacgacctgaagccgcgtgacatcgtgacccgcaaatcgattgagaacgcgattgccgttgtgatggcgattggcggctcgaccaacgcggtgctgcatttcctggcgattgcccatgccgcaggcgtggagtggacgattgacgactttgagcgtgtacgccaaaaaaccccggtgttgtgcgacctcaaaccgagcggcaagtacctggcggtggacctgcaccgcgccggtggcattccgcaagtgatgaagatgctgctaagcgctggcctgctgcacggcgactgcatcaccatcaccggccagaccgtggctgaagtgttgaaagacgtgccggatgcaccacgggcagaccaaaacgtgattcggccgatgaacaaaccgatgtatgcccagggccatctggccattctgaagggcaacctggccccggaaggctgcgtcgccaagatcaccggcctgaaaaacccggtcatgaccggcccggcacgcgtctttgaggacgaacaatcggccttggccgcgattctggccaacaagattgtggccggcgatgtcatggtgctgcgctacctcggccccaaaggcggccccggcatgcccgaaatgctggccccgaccggcgcgctggtcggccagggtttgggcgaatcagtcggcctgatcaccgacggccgtttctccggtggcacctggggcatggtggtcggtcacgtggcaccggaagcggctgccggcggcctgattgctttgattgaagaaggcgactcgatcaccatcgacgcgcaccagttgctgctgcaactcaacgtcagcgacgacatcattgccaaacgccgtagcgtgtggacggccccgcagccgcgctacacacgcggcgtgcaggccaagtttgcctttaacgcatccaccgccagcaagggtgcggtgctggacaactactga

SEQ ID NO: 364 - protein, 564 aa, Rhodoferax ferrireducens
MDIKPVILNPRSKNITEGKSRAPNRSMYYAMGYEADDFKKPMIGVANGHSTITPCNSGLQKLADAAIAAIEEAGGNAQVFGTPTISDGMSMGTEGMKYSLVSREVISDCIETCVQGQWMDGVLVIGGCDKNMPGGLMGMLRANVPAIYVYGGTILPGHYKGQDLNIVSVFEAVGENAAGRMSDEDLLEIERRAIPGPGSCGGMYTANTMSSAFEALGISLVYSSTMANPHDEKLNSAQESAKVLIEAIKNDLKPRDIVTRKSIENAIAVVMAIGGSTNAVLHFLAIAHAAGVEWTIDDFERVRQKTPVLCDLKPSGKYLAVDLHRAGGIPQVMKMLLSAGLLHGDCITITGQTVAEVLKDVPDAPRADQNVIRPMNKPMYAQGHLAILKGNLAPEGCVAKITGLKNPVMTGPARVFEDEQSALAAILANKIVAGDVMVLRYLGPKGGPGMPEMLAPTGALVGQGLGESVGLITDGRFSGGTWGMVVGHVAPEAAAGGLIALIEEGDSITIDAHQLLLQLNVSDDIIAKRRSVWTAPQPRYTRGVQAKFAFNASTASKGAVLDNY

SEQ ID NO: 365 - DNA, 1707 bp, Verminephrobacter eiseniae
atggcagacaacaagacgaccacgatcgagcctatcaaccgccgcagcgcgaacatcacacagggcaagtcgcgcgcacccaaccgctccatgtactacgccatgggctacgtggagggcgacttcgtcaagccgatggtcggcgtggccaatggccacagcaccatcacgccttgcaacagcgggctgcaaaaactgaccgatgccgccatcgagggcatcgaggaggccggcggcaatgcccaggtgttcggcacgccgaccatctcggacggcatggccatgggcaccgaaggcatgaagtacagcctggtcagccgtgaagtcatcagcgactgcatagaaacctgcgtcagcggccagtggctggacggcgtgctggtggtcggcggctgcgacaaaaacatgcccggcggcctgatgggcatgttgcgcgccaacgtgcccgcaatctatgtgtacggcggcaccatcctgcccggccactaccaggggcgggaactgaatatcgtcagcgtgttcgaggcggtgggcgaaaacgccgccggcaagctgagcgaccacgacctcagggagatcgaaaagcgcgccatccccggcaccggctcctgcggcggcatgtataccgccaacaccatgtccagcgcgttcgaggccctgggcatcagcctgccctactcgtcgaccatggccaacccgcatgacgagaagacgaactcggccaaggcatcggccaaggtgctgatcgaggccatccgcaacgacctcaagccgcgcgacatcgtgaccaggaaggccatcgagaatgcagtggccgtgatcatggccaccggcggctcgaccaacgccgtgctgcatttcctggcgatcgcccatgcggcaggcgtgccgtggagcatcgacgacttcgagcgcgtgcgccagaagacccccgtgctgtgcgacctcaagcccagcggcaaatacctggccgtggacctgcaccgcgcgggcggcatcccgcaggtgatgaagctgctgctcaacgccggcctgctgcatggcgactgcatcaccatcgagggcaagacgatggcccaagtgctcaaggatgtgcccgatcggccgcgcgcagaccagaacgtgatccgccccatcgaccagcccctgtacgcgcagggccacctggccatcctcaagggcaacctcagccccgaaggggccgtggccaagatcaccggcctgaagaacccggtcatcaccggcccggcgcgcgtgttcgacgacgagcaatctgcgctgcaggcgatactggacggcaagatccaggccggcgacgtgatggtgctgcgctacctggggcccaagggcggccccggcatgcctgaaatgctggcccccaccggcgcgctgatcggcgccggcctgggagaaagcgtgggcctgatcaccgacgggcgcttttccggcggcacctggggcatggtcgtcggccatgtggcgcccgaggccgccgcaggcggcaccatcgctttcgtgcatgaaggcgacagcatcaccatcgacgcccgccaactgctgctgcaattgaatgtggctgaggcagaaatcgcccggcgccgtgcccggtggacggcccccgctgcgcgctacacacgcggcgtgcaggccaagttcgccttcaacgcatcgagcgccagccaaggcgcggtgctcgacgcatactga

SEQ ID NO: 366 - protein, 568 aa, Verminephrobacter eiseniae
MADNKTTTIEPINRRSANITQGKSRAPNRSMYYAMGYVEGDFVKPMVGVANGHSTITPCNSGLQKLTDAAIEGIEEAGGNAQVFGTPTISDGMAMGTEGMKYSLVSREVISDCIETCVSGQWLDGVLVVGGCDKNMPGGLMGMLRANVPAIYVYGGTILPGHYQGRELNIVSVFEAVGENAAGKLSDHDLREIEKRAIPGTGSCGGMYTANTMSSAFEALGISLPYSSTMANPHDEKTNSAKASAKVLIEAIRNDLKPRDIVTRKAIENAVAVIMATGGSTNAVLHFLAIAHAAGVPWSIDDFERVRQKTPVLCDLKPSGKYLAVDLHRAGGIPQVMKLLLNAGLLHGDCITIEGKTMAQVLKDVPDRPRADQNVIRPIDQPLYAQGHLAILKGNLSPEGAVAKITGLKNPVITGPARVFDDEQSALQAILDGKIQAGDVMVLRYLGPKGGPGMPEMLAPTGALIGAGLGESVGLITDGRFSGGTWGMVVGHVAPEAAAGGTIAFVHEGDSITIDARQLLLQLNVAEAEIARRRARWTAPAARYTRGVQAKFAFNASSASQGAVLDAY

SEQ ID NO: 367 - DNA, 1695 bp, Acidovorax sp.
atgaccgacccgctgccgctgaaccgccgctccgcccacatcacccagggcaaggcgcgcgcgcccaaccgctccatgttctacggcatgggctaccaagagggtgacttcgccaagcccatggtgggcgtggccaacgggcacagcaccatcacgccctgcaacagcggcctgcaacgcctggccgacgcggccatcgcaggcatcgaggaagcgggcggcaacgcccaggtcttcggcacgcccaccatcagcgacggcatggccatgggtaccgagggcatgaagtacagcctggtgagccgcgaggtgattgccgactgcgtcgagacctgcgtgcagggccagtggatggacggcgtggtcgtcatcggcggctgcgacaagaacatgcccggcggcctgatgggcatgctgcgcgccaacgtgccggccatctacgtgtatggcggcaccatcctgccgggccgctggcaggggcaagacctgaacatcgtgagcgtgttcgaagccgtgggccagaacgccgcgggcaggatgaccgaccaggagctgaaggacatcgagcagcacgccatcccgggcacgggctcgtgcggcggcatgtacacggccaacaccatgtcctcggccttcgaggcgctgggcatgagcctgccctactcctccaccatggccaatccgcacgacgagaaaatgaactcggcccgcgaatccgcccgggtgctgatcgaggccatccgcaaggacttgaagccacgcgacatcgtcacgcgcaaggccatcgagaacgccgtggccgtgatcatggccacgggcggctccaccaacgcggtgctgcacttcctggcgatcgcgcacgcggcgggtgtggagtggtccatcgacgacttcgagcgcatgcgcaagaaggtcccagtgatctgcgacctcaagcccagcggccggtacctggccgtcgacctgcaccgcgcgggcggcattccccaggtgatgaaggtgctgctgaacgccggcctgttgcacggcgactgcatgaccatcaccggtaaaaccatcgccgaaaccctggccgacgtacccgacgcgccacggccggaccaggacgtgattcgcccgatcgacaaggcgctgtaccgcgaggggcacctcgccatcctcaagggcaacctgagtcccgagggcgccgtggccaagatcaccgggctgaagaaccccgtcatcaccgggcccgcgcgtgtgttcgacgacgagcagtcggcgctgcaggccatcctggacggcaggatcgtcgcgggcgacgtgatggtgttgcgctacctcggccccaagggtggcccgggcatgccggagatgctggcccccacgggcgcgctgatcggtgcgggcctgggcgagagcgtgggcctgatcaccgacgggcgcttctcgggcggcacctggggcatggtggtgggccacgtcgcgcccgaggccgctgcggggggcactattgcgctggtgcatgagggcgacacgatcaccatcgacgcccaccaactgctgctgcaactgcacgtggacgacgccacgctggcacagcgccgcgccgcctggcagccacccacgccgcgctacatgcggggcgtgcaggccaagtttgccttcaacgcctccagcgccagcaagggtgcggtgctggatgacttttcatga

SEQ ID NO: 368 - protein, 564 aa, Acidovorax sp.
MTDPLPLNRRSAHITQGKARAPNRSMFYGMGYQEGDFAKPMVGVANGHSTITPCNSGLQRLADAAIAGIEEAGGNAQVFGTPTISDGMAMGTEGMKYSLVSREVIADCVETCVQGQWMDGVVVIGGCDKNMPGGLMGMLRANVPAIYVYGGTILPGRWQGQDLNIVSVFEAVGQNAAGRMTDQELKDIEQHAIPGTGSCGGMYTANTMSSAFEALGMSLPYSSTMANPHDEKMNSARESARVLIEAIRKDLKPRDIVTRKAIENAVAVIMATGGSTNAVLHFLAIAHAAGVEWSIDDFERMRKKVPVICDLKPSGRYLAVDLHRAGGIPQVMKVLLNAGLLHGDCMTITGKTIAETLADVPDAPRPDQDVIRPIDKALYREGHLAILKGNLSPEGAVAKITGLKNPVITGPARVFDDEQSALQAILDGRIVAGDVMVLRYLGPKGGPGMPEMLAPTGALIGAGLGESVGLITDGRFSGGTWGMVVGHVAPEAAAGGTIALVHEGDTITIDAHQLLLQLHVDDATLAQRRAAWQPPTPRYMRGVQAKFAFNASSASKGAVLDDFS

SEQ ID NO: 369 - DNA, 1695 bp, Delftia acidovorans
atgaccccgccgaaccagatcaaccgccgaagctcccacatcaccgaaggcaaggcgcgcgcagccaaccgctccatgttctacggcatgggctacaaggaagaggatttcaagaagcccatggtcggcgtggccaacggccacagcacgatcacgccgtgcaactccggcctgcaaaggctggcggacgcggccatcgcaggcatcgaggaagccggcggcaacgcgcaggtgttcggcacgccgaccatctcggacggcatgtccatgggcacggaaggcatgaagtactcgctggtcagccgcgaggtgatcgccgactgcatagagacctgcgtgggcggccagtggatggacggcgtgctagtggtcggcggctgcgacaagaacatgccgggcggcatgatgggcatgctgcgcgccaatgtgccggccatctacgtctacggcggcaccatcctgcccggcaggtggaaaggccgggacctgaacatcgtcagcgtgttcgaggccgtcggcgaaaacgccgcgggaaagatcagcgaccaggagctcaaggacatcgagcagcacgccattcccggcacgggctcgtgcggcggcatgtacaccgccaacaccatgtcgagcgcgttcgaggcgctgggcatgagcctgccctactcctccaccatggccaatccccatgatgaaaaggaaaactcggccaaggaatccgccagggtgctgatcgaggccatcaagatggacctcaagccgcgcgatatcgtgacgcgcaagtccatcgagaacgcggtctcggtgatcatggcgaccgggggctccaccaatgccgtgctgcactttcttgcgatcgcccatgcggccggcgtgccctggtccatcgacgacttcgagcgcatccgccagcgggtgccggtgctgtgcgatctcaagcccagcggcagatacctggcggtggacctgcaccaggcgggcggcatcccgcaggtcatgaagatcctgctgaatgcgggcctgctgcacggcgactgcatcaccatctcgggccagaccattgcgcagaccctggctggcgtgcctgacgaaccaccgaacccgcagatcatccgccccctctcggatgcactctatccgcagggccacctggccattctcaagggcaacctgagcccggaaggcgcggtggccaagatcacgggcctgaagaacccggtcatcaccggcccggcacgcgtgttcgacgatgagcaatcggcactggcggccatcctcgacggcaggatacaggccggcgatgtgatggtgctgcgctacctgggccccaagggcggccccggcatgccggaaatgctggcccccacgggcgccctgatcggcgccggcctgggcgagagcgtgggcctgatcaccgatggccgcttctccggcggcacctggggcatggtggtcggccacgtggcgccggaagcggccgtgggcggcaccatcgcgctggtgcacgagggcgactcgatcaccatcgacgcgcacgcattgcggctgcagctgaacgtgcccgaagacgtgctcgcccagcgccgcgcggcatggaaggcccccgcgccccgctacacgcggggcgtgcaggccaagttcgctttcaacgcatcgagcgccagctcgggcgcggtgctggacaacttcgccatctga

SEQ ID NO: 370 - protein, 564 aa, Delftia acidovorans
MTPPNQINRRSSHITEGKARAANRSMFYGMGYKEEDFKKPMVGVANGHSTITPCNSGLQRLADAAIAGIEEAGGNAQVFGTPTISDGMSMGTEGMKYSLVSREVIADCIETCVGGQWMDGVLVVGGCDKNMPGGMMGMLRANVPAIYVYGGTILPGRWKGRDLNIVSVFEAVGENAAGKISDQELKDIEQHAIPGTGSCGGMYTANTMSSAFEALGMSLPYSSTMANPHDEKENSAKESARVLIEAIKMDLKPRDIVTRKSIENAVSVIMATGGSTNAVLHFLAIAHAAGVPWSIDDFERIRQRVPVLCDLKPSGRYLAVDLHQAGGIPQVMKILLNAGLLHGDCITISGQTIAQTLAGVPDEPPNPQIIRPLSDALYPQGHLAILKGNLSPEGAVAKITGLKNPVITGPARVFDDEQSALAAILDGRIQAGDVMVLRYLGPKGGPGMPEMLAPTGALIGAGLGESVGLITDGRFSGGTWGMVVGHVAPEAAVGGTIALVHEGDSITIDAHALRLQLNVPEDVLAQRRAAWKAPAPRYTRGVQAKFAFNASSASSGAVLDNFAI

SEQ ID NO: 371 - DNA, 1683 bp, Methylibium petroleiphilum
atgagcatcaaccgccgttcgaagaacatcaccgaaggcgtggcccgcgcacccaaccgctcgatgtactacgcgatgggctaccaggaggccgacttcaagaagccgatgatcggcgtggcgaacggccactcgaccatcacgccctgcaactcgggcctgcagaagctggccgacgccgcggtcgagggcatcgaggcggccggcggcaatgcacagatcttcggcacccccaccatcagcgacggcatggcgatgggcaccgagggcatgaagtactcgctggtctcgcgcgaggtcatcgccgactgcgtggaaacctgcgtcggcggccagtggatggacggcgtgctggtggtcggcggctgcgacaagaacatgccgggcggcatgatgggcatgctgcgcgccaacgtgcccgcgatctacgtctacggcggcaccatcctgccgggaaagtacaagggccaggatctcaacatcgtcagcgtgttcgaggccgtcggccagttcaccgcgggcaacatgagcgaggaagacttctgccagatcgagcgacgcgcgatcccgggcagtggctcctgcgggggcatgtacaccgccaacaccatgagttcggccttcgaggccctgggcatgagcctgccgttcgcctccacgatggccaatgtcgaggacccgatcgtcgcgcacaccaaggaagcggcgcgcgtgctggtcgaggcagtgaaggccgacctcaagccgcgtgacatcgtcacacgcaagagcatcgagaacgcggtcgcggtgatcatggccaccggcggctcgaccaatgcggtgctgcacttcctggccatcgcgcacgccgccggcgtcgagtggacgatcgacgacttcgagcgcgtgcgccgcaaggtgccggtgctgtgcgacctcaaacccagcggcaggtacctggcgatcgacctgcaccgcgccggcggcatcccgcaggtgatgaagacgctgctcgccgccgggctgatccacggcgactgcatcaccatcaccggaaggaccgtggccgagaacctggccgacatccccgatgcgccgcgcgccgaccaggacgtgatccgcccgatcacgaagccgatgtacgagcaaggccacctggccatcctgaagggcaacctgtcgcctgagggcgccgtggccaagatcaccggcctgaagaatcccagcatcactggcccggcgcgcgtgttcgacgacgagcagtcggcgctggccgccatcatggccaagcagatccaggccggcgacgtgatggtgctgcgctacctgggcccgatggggggcccgggcatgcccgagatgctggcgccgaccggtgcgctgatcggccaagggctgggcgaatcggtggggctcatcaccgacggccgcttctccggcggcacctggggcatggtggtcggccacgtggcacctgaggccgcggccggcggcacgatcgcgctggtgcaggaaggcgactcgatcaccatcgatgcgcacacgctggtgctcaacctcaacgtgagcgaggccgagatcgcaaagcgtcgcgccgcctggaaggcaccggcgccgcgctacacacgcggcgtgctggccaagttcgcgaagaacgcgtcaagcgccagcagcggcgcggtattggaccgcttcgagtag

SEQ ID NO: 372 - protein, 560 aa, Methylibium petroleiphilum
MSINRRSKNITEGVARAPNRSMYYAMGYQEADFKKPMIGVANGHSTITPCNSGLQKLADAAVEGIEAAGGNAQIFGTPTISDGMAMGTEGMKYSLVSREVIADCVETCVGGQWMDGVLVVGGCDKNMPGGMMGMLRANVPAIYVYGGTILPGKYKGQDLNIVSVFEAVGQFTAGNMSEEDFCQIERRAIPGSGSCGGMYTANTMSSAFEALGMSLPFASTMANVEDPIVAHTKEAARVLVEAVKADLKPRDIVTRKSIENAVAVIMATGGSTNAVLHFLAIAHAAGVEWTIDDFERVRRKVPVLCDLKPSGRYLAIDLHRAGGIPQVMKTLLAAGLIHGDCITITGRTVAENLADIPDAPRADQDVIRPITKPMYEQGHLAILKGNLSPEGAVAKITGLKNPSITGPARVFDDEQSALAAIMAKQIQAGDVMVLRYLGPMGGPGMPEMLAPTGALIGQGLGESVGLITDGRFSGGTWGMVVGHVAPEAAAGGTIALVQEGDSITIDAHTLVLNLNVSEAEIAKRRAAWKAPAPRYTRGVLAKFAKNASSASSGAVLDRFE

SEQ ID NO: 373 - DNA, 1683 bp, unknown
  gamma proteobacterium KT 71
atggcgctcaatcgtcgctccaaaaacatcaccgagggcgtccaacgtgcgcccaatcgctccatgtactacggcatgggctatgaggagggcgattttaggaagcccatggtgggcattgccaactctcactcgacgatcacgccctgtaatgcgggactccagcccctggctgatgccgctcaggaaggcctgaaagaagccggggccaatcctcaggtgtttggcacgccgaccatatccgacggcatgtccatgggtaccgagggcatgaagtactccctggtatcccgggaagttatcgctgactgcatcgaaacctgcgtgggcggtcagtggatggacggcgtgctggtgatcggtggctgtgacaaaaacatgcccggcggcatgatgggcatgctccgcgcaaacgtcccctcgatttttgtatacggcgggaccattcttcccgggcgtcacaatggtcaggatctgaacatcgtcagcgtgtttgaggcggtcggtgagcatgcggcggggcgtatcagggacgaggatttactggctatcgaacgcaatgcgattccgggaacgggctcctgcggcggtatgtataccgcaaacaccatgagctcggcctttgaggccctgggcatgagccttccttattcctcgaccatggcaaacgtcgagtccgaaatcaaagaatcagccaaggcgagcgcgctggctctggtggaggcgattcgcctggatcttaagcccagggatattgtgacccgcgagtccctggaaaatgccgttgcggtgattatggcgaccgggggatcgaccaatgcggtattacactttctggcgattgcccacgccgcggagattgactggagtatcgacgactttgagcgaatccgacaaaaagtaccggtgctctgcgatctcaagcccagcggggagtatctggccattgatctgcaccgtgctggcggcattccccaggtgatgaaaattctcttggacgggggcttgctccacggcgactgcatgaccgtaacgggcaagactattgcggaatccctggcggatgtgccttcgacgcccgtggaccccaaggtcattcgtcctctggataaccccatgtatgccaaggggcatctggcgattcttcgcggcaatctcgccgaagagggcgccgtagccaaaatcacgggtctgaaaaaccccgtgatcacgggacctgcgaaagtgtttgatgatgaacagtcggcccttgatgccattctcgcgggcaaggtcaaagccggtgacgtggtggtactgcggtatctagggccccagggcggaccgggtatgcccgagatgctggcacccaccagtgctctggtggggcagggtctcggggagtccgtaggcctgattaccgacggccgattttccgggggcacctgggggatggttgtggggcatgtggcacccgaagcctatgcgggtggtctcattgccctgatagaggagggggactccatcaccatcgatgcccataccctgagtctggaactcaatgtcgacgacaaagaaattgctcgccggcgcggcgcctgggtaaagcccgagccacgctacacccggggcgtcctcgccaagtttgcaaaaaatgcagccaccgcaagccgcggcgcggtgctggatctgtatgaggactaa

SEQ ID NO: 374 - protein, 560 aa, unknown
  gamma proteobacterium KT 71
MALNRRSKNITEGVQRAPNRSMYYGMGYEEGDFRKPMVGIANSHSTITPCNAGLQPLADAAQEGLKEAGANPQVFGTPTISDGMSMGTEGMKYSLVSREVIADCIETCVGGQWMDGVLVIGGCDKNMPGGMMGMLRANVPSIFVYGGTILPGRHNGQDLNIVSVFEAVGEHAAGRIRDEDLLAIERNAIPGTGSCGGMYTANTMSSAFEALGMSLPYSSTMANVESEIKESAKASALALVEAIRLDLKPRDIVTRESLENAVAVIMATGGSTNAVLHFLAIAHAAEIDWSIDDFERIRQKVPVLCDLKPSGEYLAIDLHRAGGIPQVMKILLDGGLLHGDCMTVTGKTIAESLADVPSTPVDPKVIRPLDNPMYAKGHLAILRGNLAEEGAVAKITGLKNPVITGPAKVFDDEQSALDAILAGKVKAGDVVVLRYLGPQGGPGMPEMLAPTSALVGQGLGESVGLITDGRFSGGTWGMVVGHVAPEAYAGGLIALIEEGDSITIDAHTLSLELNVDDKEIARRRGAWVKPEPRYTRGVLAKFAKNAATASRGAVLDLYED

SEQ ID NO: 375 - DNA, 1665 bp, Tremblaya princeps
atgaacacgaactcaagacgcataacgcatggattcaccaggtctccgaacagggccatgctctgtgccatggggtacgatggcgcagactttgccaagcccatcataggcgtaggaagcggttactccaccataacaccgtgcaatgctggcatacagcgcgtcgtcgatgcggcgaaagccatgctggcaaggcatggagccatgacgcaggttttcggcatccctaccatatccgacggcatatcaatgggcacgccgggcatgaggtactctctcgtgtctcgtgaggtgatcgctgattgtatagaggcatgtgcttgtgggcagagcatggacgggctgctagtcgtagggggctgcgataagaacctgcctggtggcatgatcgggctactacgagccaacatcccagggatttacctgtatggcggcacaatactgccagggtactggggcgccagggagctgactgtggtgagttcattcgaggcagttggcgccatgggtaggcagggcatgtctatagacgctatgcgtgaagtggagcgacacgcctgccccactacaggctcgtgcggcgggatgtacacagcaaacacaatgagcgcatcatttgaggcccttggcatgtccctgctctactcgtccactgctccgagcccaggcatcgagggtgagctatccatctcaacgtcggcacggtctctgatcaacgcagtgcgacggggcataaggccaagggacgtggtaactcacaggtccattcgcaatgccatggcggttgtaatggcagtcggcgggtctacaaacgccgtgctgcactacctggcgatagccgctgcagctcgttctgctctctcactgcacgacgttgagctaataaggaggagggtgcctgtaatatgtaacatgaagccctctggactgcatagcactgcagacctacattcagcaggcggcgttcctcgtgttatgcacgagcttgcgctcgctggtctcattgacgagtcgtgcctcacgataacgggcagaacgataggtgcagagctcctcgcggcgcaccgcaagcgccatggctctaccgttgtgctgcctactaacatggcgttataccgtacaggacgccttgttgtgctgagcggtaatatgtcaaggaacggcgcagttgccaagacttcaggccttagcatactattgcacagcggcactgccagagtgtttcgcagcgaggaggcctgtgttcaggctatactcaacggctgcgtgcgcattggcgacgtagttgtgctgatttacctaggcccaaagggagggcctggcatgcctgagatgctatccccaactgcagcgctagttggcatgggactaggccagtccgcttgcctcattacagatggtaggttctctggaggaacgtggggcctggtggtcgggcatgtatcacccgaggcagccgtgggtggctccatagcgcttgtccgtaacggcgacttcatcacagtagacctgcgcaacaactctcttcacctgcatatagacgcatggtcgcttgctgcacggcgtgcagcatggcggctaccttgcactttgtgtgtagagggactactgagaaagtaccacgatggagttggccagtctcacaatggcgccatcgctgcatag

SEQ ID NO: 376 - protein, 554 aa, Tremblaya princeps
MNTNSRRITHGFTRSPNRAMLCAMGYDGADFAKPIIGVGSGYSTITPCNAGIQRVVDAAKAMLARHGAMTQVFGIPTISDGISMGTPGMRYSLVSREVIADCIEACACGQSMDGLLVVGGCDKNLPGGMIGLLRANIPGIYLYGGTILPGYWGARELTVVSSFEAVGAMGRQGMSIDAMREVERHACPTTGSCGGMYTANTMSASFEALGMSLLYSSTAPSPGIEGELSISTSARSLINAVRRGIRPRDVVTHRSIRNAMAVVMAVGGSTNAVLHYLAIAAAARSALSLHDVELIRRRVPVICNMKPSGLHSTADLHSAGGVPRVMHELALAGLIDESCLTITGRTIGAELLAAHRKRHGSTVVLPTNMALYRTGRLVVLSGNMSRNGAVAKTSGLSILLHSGTARVFRSEEACVQAILNGCVRIGDVVVLIYLGPKGGPGMPEMLSPTAALVGMGLGQSACLITDGRFSGGTWGLVVGHVSPEAAVGGSIALVRNGDFITVDLRNNSLHLHIDAWSLAARRAAWRLPCTLCVEGLLRKYHDGVGQSHNGAIAA

SEQ ID NO: 377 - DNA, 1689 bp, Blastopirellula marina
atgtctcagcccctcaattggaatagtcgccgtttaacgcgtggatggcaaaaagggatcaccgctttttattacggcttgggactgaccgacgccgattttgacaaaccgcagatcgggatcggcgtgccgctgctggacggcaatctttgcaacgtccacgcctatcaactgggccaagagctgaaagcaggctgcgagcaagcgggactgatcgggtttccgtttggcacgccggccgttagcgataacatcacgcaaggacatgaagggggcaacgccagccttccctcgcgtaatatgatcgccaatgcggctgaatgcgtcgtcagcgcccatggctacgactttttgatcggactgcacaattgcgacaaaaacgggcccggcttcgccatggcgttggctcggctcaactatcccgggctgatcgtcaacggcggcagtattaaacctggttgccatctgggccgcgacacgtcgatcttggatgtctacgacgcccaagcggcggcttccgtgggcgcaatgacggcggacgaagcggatcagatcttgcgaaccgcttgtcccggacccggcgggtgcggcatcgccgcttcttttaatacttggggaatcgcgatcgaagcgatcgggctagggcttccctactccagttcgatcccggctgaagatccggccaaacgcgaagaatgccgcagcatcggccaagcagtcaagcatctgctgaccgagaacattcgcccccgcgatattttgaccaaaaaggcgtttgaaaacgcagccgcggtgatcgccgccgtgggcggctcgaccaacggcgtgctgcacctgatcgcgctggccaaagaagccgaagttgatttcacattgcgtgacgtgcagcggattgtccgcaacacgccggtcctgtgcagcttcgctccgcgcggcaaacgcacgatgtacgacctgcacaagctggggggtacgccgatgctgctgaagtacttgatctcggtcggcattgtcgatggttcgtgcctgaccgtctcgggcaagtcattggccgaaaacgtcaacggcgcggccgatgttcccgcggatcaagacttgatcgcgacgatcgaaaagccgttcaaagaatatgccgacatgcagatctgctttggcaacctggcgcccggcggcgtggtcttcaaagtatcgagcatgcgtgacccaaaattcagcggcaaagcgatctgcttttcggaagccaaggatatcgtcaacgcggtcgaagcgaataagatcacgccgggaaccgtgatcgtgcttcgttatctggggccggtcgcttcggggatgccggaagtgttggtcgcgaccgcggctttggccgtaccgcatctggacggcaaagtagcgtttctgtcagacacgcgcgtctctggcgtatcgcacggagcgatcggcgttcactgtgctccggaagcggcagtcggcgggccgatcgcgttggtggaagacggggatgaaatctcgtttgatctgctcggcggcgagatcacgctgcacgtcggagcagacgtgttggcgactcgcgccgccaactggaagacgcctgacctgcggcacaaacatgcctatctggccgacttcgccgcaaccgtctcgcaagccgatagcggttgcgtcagcaaagcgtttcacgacgtctcgtaa

SEQ ID NO: 378 - protein, 562 aa, Blastopirellula marina
MSQPLNWNSRRLTRGWQKGITAFYYGLGLTDADFDKPQIGIGVPLLDGNLCNVHAYQLGQELKAGCEQAGLIGFPFGTPAVSDNITQGHEGGNASLPSRNMIANAAECVVSAHGYDFLIGLHNCDKNGPGFAMALARLNYPGLIVNGGSIKPGCHLGRDTSILDVYDAQAAASVGAMTADEADQILRTACPGPGGCGIAASFNTWGIAIEAIGLGLPYSSSIPAEDPAKREECRSIGQAVKHLLTENIRPRDILTKKAFENAAAVIAAVGGSTNGVLHLIALAKEAEVDFTLRDVQRIVRNTPVLCSFAPRGKRTMYDLHKLGGTPMLLKYLISVGIVDGSCLTVSGKSLAENVNGAADVPADQDLIATIEKPFKEYADMQICFGNLAPGGVVFKVSSMRDPKFSGKAICFSEAKDIVNAVEANKITPGTVIVLRYLGPVASGMPEVLVATAALAVPHLDGKVAFLSDTRVSGVSHGAIGVHCAPEAAVGGPIALVEDGDEISFDLLGGEITLHVGADVLATRAANWKTPDLRHKHAYLADFAATVSQADSGCVSKAFHDVS

SEQ ID NO: 379 - DNA, 1692 bp, Planctomyces maris
atggatcatcctttaaactggaatagtcaaaacctgacacatggctggcaacggggagtcaccgctttttattacgggttaggcttttcggatcaggatttcgacaaggcccagatcgggattggcgtgccactcttggatggcaacctctgtaatgtgcatgcttacgatcttgcgaaagtaattgcacagggatgtcaatccgctgacatgatcggtcttccttttggagttcccgccgtcagtgacaacatcacccagggacaggaaggaggcaacgccagtctcccctctcggaatatgatcgccaacgcggccgaatgcgtcgtgagtgctcattcgtatgatgccctgattggcctgcataattgcgataaaaacggaccgggcttcgccatggcattggcacgactcaactatccgggactggtcgtcagtggtggcagtatcatgcccggctgccacaaaggacaggacatttcgatcctcgacgtctacgattcccaggcagctgcagcagtcggcgcgatggaagaagaagaagcggaccagattctgaaaaccgcctgcccgggcccggggggatgtggtatcgccgcttctttcaatacctggggcatcgcgctcgaagccatcggccttatgctcccgttcagcagttccacgccggccattgataatgcaaaaaaaacagaatgcctcaatgtcgcctctgccgtgcgaaatctcctgcagaaaaatatccggccgcgcgacatcctgacccgcaaagcatttgaaaatgcagccgccaccatcgcggccgtcggcggctccacgaatggaatcctgcatctgctcgcgctggcacgagaagcggaagtcgaattttacctgcaggacattcaggaaattcttcgaaaaacgcccgtgtattgcagttttgcaccacgcggcaaaaaaaccatggtcgacctgcatcacctgggtggcacaccggtcctcatgaaacacctgctcaaagcaggcatcatcgatggcagttgcctgactgtaaccggcagaaccctggcggaaaacctggcagaaatcggcgatgtccccacgaaccaggaactgatcgcttcgctcgatcaaccgtataaaacttacgccgacatgcagatctgctttggcaatctggcaccgggaggcattgtctttaaagtttccagcatgcaggaatcacatttcacgggaaccgcctgctgcttcgatgaagcgaaaggcgtagtcgatgccgtcgaagcaggtaagatcaaacccggcagtgtcatcgtactacgaaacctgggtccggtcgcatcaggcatgcctgaagtacttgtcgcgactgccgctctgacggtaccggaactggatggcaaagtggcattcatttcggacacacgtgtctccggtgtttcacacggtgccatcggcgtgcattgttctcccgaagcggcagtcggaggtccgattggtctgattcaggatggtgaccagatctcgttcgatctgcttaaaggagaaatcagcgttgatgtctccgaccaggaatttcagcaacgccgagtgaaaaaaccacttcaacccgtcagacattcccgcggctatctggctgatttttcagccaccacctcacaggcacatcatggctgtgtgagtaaagccctgctgccggactgcgaataa

SEQ ID NO: 380 - protein, 563 aa, Planctomyces maris
MDHPLNWNSQNLTHGWQRGVTAFYYGLGFSDQDFDKAQIGIGVPLLDGNLCNVHAYDLAKVIAQGCQSADMIGLPFGVPAVSDNITQGQEGGNASLPSRNMIANAAECVVSAHSYDALIGLHNCDKNGPGFAMALARLNYPGLVVSGGSIMPGCHKGQDISILDVYDSQAAAAVGAMEEEEADQILKTACPGPGGCGIAASFNTWGIALEAIGLMLPFSSSTPAIDNAKKTECLNVASAVRNLLQKNIRPRDILTRKAFENAAATIAAVGGSTNGILHLLALAREAEVEFYLQDIQEILRKTPVYCSFAPRGKKTMVDLHHLGGTPVLMKHLLKAGIIDGSCLTVTGRTLAENLAEIGDVPTNQELIASLDQPYKTYADMQICFGNLAPGGIVFKVSSMQESHFTGTACCFDEAKGVVDAVEAGKIKPGSVIVLRNLGPVASGMPEVLVATAALTVPELDGKVAFISDTRVSGVSHGAIGVHCSPEAAVGGPIGLIQDGDQISFDLLKGEISVDVSDQEFQQRRVKKPLQPVRHSRGYLADFSATTSQAHHGCVSKALLPDCE

SEQ ID NO: 381 - DNA, 1686 bp, Microcystis aeruginosa
atggcagataactacagaagtcgcattgttacccaaggtacccaacgcagtcctaatcgggccatgttaagagcggtaggttttggggatgaggactttagcaaaccaatcatcggcattgctaacggatttagcaccattaccccctgtaacatgggaattaatgatttagcaatgcgtgccgaagcagccaccagattagcggggggaatgccgcaacttttcgggactatcaccattagtgacgggatttccatgggaacagaaggaatgaaatattctctcgtttctagggaagtaatcgccgattccattgaaaccgtctgtaatggtcaaagtctcgatggagtcctcgctatcgggggttgtgacaaaaatatgccgggagcaatgattgccatggcccggatgaatattcccgctattttcgtctatggtggcacaattaaaccgggacgctacaaagattgcgatttaaccgtggtcagttcctttgaagccgtgggacagtacagcgccggtaaaatcagcgaagaagacctcatcgggattgaacgcaacgcttgccccggtgctggttcctgtggtggaatgtttactgctaataccatgtcttccatttttgaagccatggggatgagtttaccctattcctcaaccatggccgccgaagatgaggaaaaagccgatagtaccgaagaatcggccaaggttttagtcgaggcggttagaaaacagattctacctagccaaattttgacccgtaaagcctttgaaaacgccatttcggtaattatggcggtgggaggttccactaacgctgtcctgcaccttttagccatttcccgcaccatcggggtagaattatcgatcgatgattttgaaaccatccgccagcgtgtaccagttatctgcgatcttaaaccctccgggcgttacgttaccgtagatctgcataaagccggcggtattccccaagtgatgaaaattctcctggttaatggtttactacacggggatgctctcaccattagcggtcagactatcgccgagattttagccgatattcccgaccaaccgccctcaggccaagatgttatccgtccttttagcaatcctgtctataaagagggtcatttagccattttaaaaggaaatctggccacggaggggtctgtggccaaaatcagcggcgtgaaaactccggtcatcactgggcccgcgcgggtgtttgagtcggaagaaacctgtttagaggcaattttagccggaaaaattcaagccggggatgtggtggttgtccgttacgagggaccagtaggcggaccgggtatgcgggaaatgttagcccccacttcggcaattatcggcgctggtttaggggattccgtgggattaattaccgatggtcgtttttccgggggaacctatggcatggtagttggtcacgtcgctccagaagcggcggtgggtggtacaattgccctagtagaggaaggggatcaaatcactattgatgctcgtcaacgtctcttgagtttaaatgtatcggaggaagaattaacccgtcgtcgtcaccattggcaaccgcgtcccccacgctataaaacgggaattctcggcaaattcgccaagttagtctcctctagcagtctcggcgctttaacggatttgaatctgttctaa

SEQ ID NO: 382 - protein, 561 aa, Microcystis aeruginosa
MADNYRSRIVTQGTQRSPNRAMLRAVGFGDEDFSKPIIGIANGFSTITPCNMGINDLAMRAEAATRLAGGMPQLFGTITISDGISMGTEGMKYSLVSREVIADSIETVCNGQSLDGVLAIGGCDKNMPGAMIAMARMNIPAIFVYGGTIKPGRYKDCDLTVVSSFEAVGQYSAGKISEEDLIGIERNACPGAGSCGGMFTANTMSSIFEAMGMSLPYSSTMAAEDEEKADSTEESAKVLVEAVRKQILPSQILTRKAFENAISVIMAVGGSTNAVLHLLAISRTIGVELSIDDFETIRQRVPVICDLKPSGRYVTVDLHKAGGIPQVMKILLVNGLLHGDALTISGQTIAEILADIPDQPPSGQDVIRPFSNPVYKEGHLAILKGNLATEGSVAKISGVKTPVITGPARVFESEETCLEAILAGKIQAGDVVVVRYEGPVGGPGMREMLAPTSAIIGAGLGDSVGLITDGRFSGGTYGMVVGHVAPEAAVGGTIALVEEGDQITIDARQRLLSLNVSEEELTRRRHHWQPRPPRYKTGILGKFAKLVSSSSLGALTDLNLF

SEQ ID NO: 383 - DNA, 1839 bp, Salinibacter ruber
gtgaggctgccgtctttcacgcttcacgtttcacgcatcacgaaaacagcaccttctttcccttccacttttcccttttgcccaatgcccccctcctccgccaacggccactcctccaaaatccagagccaagacgtcaccgagggccttgaccaggcgccggcccgcgcgatgtttcgggcgatgggctacgacgacgccgacctcgaccagcccctcatcggcatcgccaacccggcggcggacgtgacgccctgcaatgtgcacctcgacggccttgccgacgccgcacgcgaaggcgtcactgaggccggcgggacgcccatcgagtttggcaccatcacggttagcgacgggatctcgatgggcacggagggcatgaaggggtccctcatctcccgcgaggtgatcgccgactcggtggaactggtggcctttgccgagcggctcgacgggctcgtcatcatgggcggctgcgacaaaaacatgccgggcatgatgatggcggcgatccgggccgacctcccgagcgtcttcctctacggcgggtccatcatgccgggccaccaccgggggcaggagatcacgatccagaacgtgttcgaggcgtgcggggcggtcgccaccggccagatgagcgaagaggagctcgacgagatggagcgccacgcctgtcccggcgccggcgcctgcggcggcatgttcaccgctaacacaatggcgtccatcagcgaggcgatcggctttgcgccgctggggagcgcgagccccccggcggtgacagaagaacgagaggtggtggcccgcgcggccgggcggcggaccgtcgaggcgatcgaggaacggcggcggccctccgacttcctcagcaagaagtcgttcgagaacgccattgccctccaggtggccgtgggcggctccacgaacggcgtactccacctgctcgcgatggcggcggaggcgggcatcgacctctcgattgaggcgttcgacgcaatcagccggcggacgcccaagatcggcgacttccagcccggcggctcccgcgtgatgaacgacctgcacgaggtcggcggcgtgccggtggtgctgaaggcgcttctcgatgcgggcctgctgcacggcgacgcccagaccgtgacgggggagcccctcgccgaggccctcgaccgcgtcgacccgcccgccatcgcggacctcgacgtggactacctctacacggtggacgaaccgaagaatgaggagggcgccatccgcatcctcaccggcaacctcgcccccgacggcgctgtgctcaaagttacagccgctgatgccccccgctttgagggcacggcccgcgtcttcgagagcgaggaggacgcaatggactacgtgcaggccggccagctcgactcgggcgacgtcattatcattcggaatctcgggcccaagggcgcccccggcatgcccgaaatgcttggcgtgaccgccgcccgggacggacaggggcacgccgacgacgtggccctcatcaccgacgggcgcttctccggggccacccgcggcctctccatcggccacgtcgcccccgaggccgcggccggcgggcccatcgccgccatccaggacggagacccgatcatcatcgacgtggcggagcgtcacctggcggtcgacctgtccgacgccgagctggagcgccgactcgacgaccggtcgcccccggagccccagtacacgaccggcgttctcgccaagtacgccgccctcttcggctccgccgcggagggggcagtgacgagtgtcttttcggatcttcgcgagtcgacatccccctccacggcttcaaatgaatga

SEQ ID NO: 384 - protein, 612 aa, Salinibacter ruber
MRLPSFTLHVSRITKTAPSFPSTFPFCPMPPSSANGHSSKIQSQDVTEGLDQAPARAMFRAMGYDDADLDQPLIGIANPAADVTPCNVHLDGLADAAREGVTEAGGTPIEFGTITVSDGISMGTEGMKGSLISREVIADSVELVAFAERLDGLVIMGGCDKNMPGMMMAAIRADLPSVFLYGGSIMPGHHRGQEITIQNVFEACGAVATGQMSEEELDEMERHACPGAGACGGMFTANTMASISEAIGFAPLGSASPPAVTEEREVVARAAGRRTVEAIEERRRPSDFLSKKSFENAIALQVAVGGSTNGVLHLLAMAAEAGIDLSIEAFDAISRRTPKIGDFQPGGSRVMNDLHEVGGVPVVLKALLDAGLLHGDAQTVTGEPLAEALDRVDPPAIADLDVDYLYTVDEPKNEEGAIRILTGNLAPDGAVLKVTAADAPRFEGTARVFESEEDAMDYVQAGQLDSGDVIIIRNLGPKGAPGMPEMLGVTAARDGQGHADDVALITDGRFSGATRGLSIGHVAPEAAAGGPIAAIQDGDPIIIDVAERHLAVDLSDAELERRLDDRSPPEPQYTTGVLAKYAALFGSAAEGAVTSVFSDLRESTSPSTASNE

SEQ ID NO: 385 - DNA, 1731 bp, Methylobacterium chloromethanicum
atggacgcgcgtcagaccgacaagtcgaagctgccgagccggcacgtgacggaggggcccgagcgggcgccccaccgctcgtacctctacgccatgggcctgacgaccgagcagatccaccagccgctggtcggcgtcgcctcgtgctggaacgaggccgcgccctgcaacatctcgctgatgcgccaggcccaggccgtgaagaagggcgttgccgccgccaagggcaccccgcgcgagttctgcaccatcaccgtcaccgacggcatcgccatgggccatggcggcatgcgtgcctcgctgccgtcgcgcgaggtcatcgccgattcggtcgagctgacgatccgcggccattcctacgacgccctcgtggggctggccggctgcgacaagtccctgcccggcatgatgatggccatggtgcgcctcaacgtgccgtcaatcttcatctatggcggctcgatcctgccgggctcgttccggggccggccggtcacggtgcaggatctgttcgaggcggtcggcaaggtcgccgtcggtgacatgagcctcgacgacctcgacgagctggagcgggtcgcctgcccctcggccggcgcctgcggcgcgcagttcaccgccaacaccatggccaccgtctccgaggcgatcggcctcgcgctgccctactcggccggcgcgcctgccccttatgagatccgcgaccaattctgcgccgccgccggcgagaaggtgatggagctgatcgccaagaacatccgcccgcgcgacatcgtcacccgcaaggccctggagaacgccgctgcgacggtcgcggcctcgggcggttcgaccaacgcggccctgcacctgccggcgatcgcgcatgaatgcggcatcgagttcaccctgttcgacgtcgccgagatcttccgcaagaccccctacatcgccgacctgaagcccggtgggcgctacgtggccaaggacatgttcgaggtcggcggcatcccgctgctgatgaagacgctgctcgaccacggctacctgcacggcgactgcctcaccgtcaccggccgcaccatcgcggagaacctcgccaaggtcgcctggaacccggatcaggacgtcgtgcgcccggccgataagcccatcaccgtcaccggcggcgtggtgggccttcgcggcaatctcgcccccgagggcgcgatcgtgaaggtcgccggcatgccgcccgaggcccaggtcttcaccggcccggcccgcgtcttcgacggcgaggaagcctgtttcgaggcggtgcagaaccgcacctacaagcccggcgacgttctggtcatccgttacgagggcccgaagggaggccccggcatgcgcgagatgctctcgaccaccgccgccctctacggccagggcatgggcgacaaggtggccctcatcaccgacgggcgcttttccggcgcgacccgcggcttctgcgtcggccatgtcggccccgaggctgccatcggcgggccgatcggcctgctgcgcgacggcgacatcatcaccctcgacgcgatcaagggcacgctcgacgtggcgctctccgacgaggaactggcccagcgtcgcagcgaatgggcgccgcggggcaatgccgcgacctccggctacctctggaaatatgcgcagtccgtcggacctgcggtgaacggggccgtgacgcatccgggcggcgcgggggagacgaacgtctatgccgacatctag

SEQ ID NO: 386 - protein, 576 aa, Methylobacterium chloromethanicum
MDARQTDKSKLPSRHVTEGPERAPHRSYLYAMGLTTEQIHQPLVGVASCWNEAAPCNISLMRQAQAVKKGVAAAKGTPREFCTITVTDGIAMGHGGMRASLPSREVIADSVELTIRGHSYDALVGLAGCDKSLPGMMMAMVRLNVPSIFIYGGSILPGSFRGRPVTVQDLFEAVGKVAVGDMSLDDLDELERVACPSAGACGAQFTANTMATVSEAIGLALPYSAGAPAPYEIRDQFCAAAGEKVMELIAKNIRPRDIVTRKALENAAATVAASGGSTNAALHLPAIAHECGIEFTLFDVAEIFRKTPYIADLKPGGRYVAKDMFEVGGIPLLMKTLLDHGYLHGDCLTVTGRTIAENLAKVAWNPDQDVVRPADKPITVTGGVVGLRGNLAPEGAIVKVAGMPPEAQVFTGPARVFDGEEACFEAVQNRTYKPGDVLVIRYEGPKGGPGMREMLSTTAALYGQGMGDKVALITDGRFSGATRGFCVGHVGPEAAIGGPIGLLRDGDIITLDAIKGTLDVALSDEELAQRRSEWAPRGNAATSGYLWKYAQSVGPAVNGAVTHPGGAGETNVYADI

SEQ ID NO: 387 - DNA, 1797 bp, Schizosaccharomyces pombe
atgatgttctgcaagcttctccgttgtcaaaacggtattgctagcaaaagagctgcattaagcctaaaaggctttaaaacctcttcgatcaatttagtcgagaagaaattgaacaagtatagtgaaacaatcactggtccgaagtctcagggtgcttcccaagctatgttatatgctactggacttaatgaggaggacatgaaaaaaccccaagtcggcattgctagttgttggtatgaaggaaatccttgcaatatgcatttacttgatctcggtcgacgagtgaaagaaggtgtcaaaaaggctggattgaccggattccagtttaatactattggtgttagtgatggtatttctatgggtactactggtatgcgttatagtttgcaatctcgtgagattattgcagactccattgagaccgtcatgcaaggtcaatggtatgatgccaacgtctctattcctggctgtgacaaaaacatgcctggttgtttaatcgctatgggaagattcaaccgccctagtattatggtttacggcggtagtattcgtgctggtcactctccttgtcagaacaatgcacccatcgatattgtttctgcttttcaatcctatggtgaatttatcacaggaaaaattgatgagccaacccgtcatgacattattcgtcatgcatgtcctggaggtggtgcttgtggtggtatgtatactgcaaatacaatggctagctgtgccgaagctatgggtatgacattacccggttcttcttcttaccttgctggctcacctgagaagtttgcagaatgcgaagctgcaggtagtgctataaagcgacttttggttgacgacattaaacctcgcgacatcatgacacgttctgcttttgaaaatgctatggtcttgacgatgactcttggtggctctaccaactctgttcttcatttgatcgcaattgctaagtctgttggtatcactttaactttggatgatttccaagccgtcagtaaccgtacaccgtttattgccgatatgaagcctagcgggaagtacgttatggaagatttgttcgctatcggaggtattccttcagtacttaaatatctccatgctgaaggtctcatcgatggttctaatattaccgttactggtaaaactctcgctgagaacctacgaggattcaaggaccttgccgaaggtcaaaagatcattagacctttgagcaaccccatcaagaccgagggtcatttacgtgtcctccgtggttctttagcccctgaaggttctgtcgcaaagattactggcaaagagggcttgaacttcaccggcaaagctcgtgtttttgatgccgaaaacgattttattgctgccttagagcgtggtgagttcaagaagggcgagaagactgtcgtcattattcgttttgagggaccaaaaggtggacctggtatgccggaaatgttaaagccttcaagtgctattatgggagctggtcttggaaaggatgttgcacttttgactgacggtcgtttcagtggtggctctcacggatttttgattggacacgttgatcccgaagcacaagttggaggccctattgctcttgttcaggacggcgatgtcattgaaatcaatgctgtaaagaacactttagatttgatggttgatgagaaggagatggcgagacgccgcagtgtttggaaggcacctcctttgaagtaccaacaaggaacccttttaaaatatgctcgcaacgttagcactgcctccaagggtgctgttacagattccttagagtaa

SEQ ID NO: 388 - protein, 598 aa, Schizosaccharomyces pombe
MMFCKLLRCQNGIASKRAALSLKGFKTSSINLVEKKLNKYSETITGPKSQGASQAMLYATGLNEEDMKKPQVGIASCWYEGNPCNMHLLDLGRRVKEGVKKAGLTGFQFNTIGVSDGISMGTTGMRYSLQSREIIADSIETVMQGQWYDANVSIPGCDKNMPGCLIAMGRFNRPSIMVYGGSIRAGHSPCQNNAPIDIVSAFQSYGEFITGKIDEPTRHDIIRHACPGGGACGGMYTANTMASCAEAMGMTLPGSSSYLAGSPEKFAECEAAGSAIKRLLVDDIKPRDIMTRSAFENAMVLTMTLGGSTNSVLHLIAIAKSVGITLTLDDFQAVSNRTPFIADMKPSGKYVMEDLFAIGGIPSVLKYLHAEGLIDGSNITVTGKTLAENLRGFKDLAEGQKIIRPLSNPIKTEGHLRVLRGSLAPEGSVAKITGKEGLNFTGKARVFDAENDFIAALERGEFKKGEKTVVIIRFEGPKGGPGMPEMLKPSSAIMGAGLGKDVALLTDGRFSGGSHGFLIGHVDPEAQVGGPIALVQDGDVIEINAVKNTLDLMVDEKEMARRRSVWKAPPLKYQQGTLLKYARNVSTASKGAVTDSLE

SEQ ID NO: 389 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 390 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 391 - DNA, 1752 bp, Kluyveromyces lactis
atgttttcacagtctgctgtaagaaggttttcaaccactagaaatgtgggcaagaagttgaacaagtactcgcatatcatcaccgaaccaaaggaccagggtgcatcgcaagcgatgctttatgccacggggtttaaggaagacgatttcggcaaggctcaagttggtgttggttcatgttggtggtctggtaatccatgtaatatgcatttgatggatttcaacaacagaatcaccgaatccgttaacaaggctgggttgaaaggtatgcaattcaataccattggtgtttctgatggtatttccatgggtaccaagggtatgagatattctttgcaatctagagaagttattgctgattcgttcgaaaccattatgatggctcaacattacgatgccaatatcgccattccatcttgtgataaaaacatgcctggtgttttgatggctatgggtagacataacagaccttccattatggtttatggtggtaccattttgccaggttctccaacttgtggttctgctaagattccaaagaagattgacgttgtttctgcgttccagtcctatggtcaatacttatccaaggaatttactgaaactgaaagacaagatgttgtgcaacatgcttgtccaggtccaggttcttgtggtggtatgtacactgctaacaccatggcctctgtggccgaagtcttgggtatgactttgccaaactcttcctctttcccagcagtttcaaaggaaaaattgaacgaatgtgacactatcggtgaagctatcaagaagactatggaactaggaattactcctcgtgacgttatgaccaaagaagctttcgaaaacgctatgacatatgtcattgctaccggtggttccactaacgctgttcttcatatggttgctgtcgctcactctgccggtgtcaagattactccagatgatttccaaagaattagtgacaagactccattgttgggtgatttcaaaccttctggtaaatatgtgatggcagatttgattaccgtcggtggtacccaagctgttatcaaatacttgtacgaagaaggcttcctacatggtaacactattaccatctccggtgacactttagcagaaagagcagctaaggctgtatctttgaaggatggtcaagacatcattcgtcctctaactaacccaattaagacaagtggtcatttacaaattctatacggaagtttggccccaggtgggtcagtcggaaaaattactggtaaagaaggtacttacttcaagggtaaggctagagtattcaacgacgaaccaggctttatttctgctttagaaaacggtgaaatcaagaagggtgaaaaaaccgttgtcattatcagatacgaagggccaagaggtggtccaggtatgcctgaaatgttaaagccatcttctgcattgatgggttacggtctaggtaaggatgttgctctattgactgacggtagattctccggtggttctcacggtttcttgatcggtcacatcgtcccagaagctgccgaaggtggtcctatcggtttggttcgtgacggtgacgaaattatcattgatgctgataacaacaagattgacttgttagttccagaagaagaaatcgctgaacgtagaagtacatggactgctccacctccacgttatactagaggatgtttatccaagtacgcaaaattggtttcaaatgcttcccatggttgcgtgactgatttgaactaa

SEQ ID NO: 392 - protein, 583 aa, Kluyveromyces lactis
MFSQSAVRRFSTTRNVGKKLNKYSHIITEPKDQGASQAMLYATGFKEDDFGKAQVGVGSCWWSGNPCNMHLMDFNNRITESVNKAGLKGMQFNTIGVSDGISMGTKGMRYSLQSREVIADSFETIMMAQHYDANIAIPSCDKNMPGVLMAMGRHNRPSIMVYGGTILPGSPTCGSAKIPKKIDVVSAFQSYGQYLSKEFTETERQDVVQHACPGPGSCGGMYTANTMASVAEVLGMTLPNSSSFPAVSKEKLNECDTIGEAIKKTMELGITPRDVMTKEAFENAMTYVIATGGSTNAVLHMVAVAHSAGVKITPDDFQRISDKTPLLGDFKPSGKYVMADLITVGGTQAVIKYLYEEGFLHGNTITISGDTLAERAAKAVSLKDGQDIIRPLTNPIKTSGHLQILYGSLAPGGSVGKITGKEGTYFKGKARVFNDEPGFISALENGEIKKGEKTVVIIRYEGPRGGPGMPEMLKPSSALMGYGLGKDVALLTDGRFSGGSHGFLIGHIVPEAAEGGPIGLVRDGDEIIIDADNNKIDLLVPEEEIAERRSTWTAPPPRYTRGCLSKYAKLVSNASHGCVTDLN

SEQ ID NO: 393 - DNA, 1770 bp, Candida albicans
atgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtccccggcagtctccaaagaaaaagccgaagagtgtgccaacgtcgggttcgccttaaagaatttgttagagttggacttgaaaccaagagatattgtcaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggttgagccagacgtcttgaccgaaagaagaaaacactggacgcctccagaaccaagatacaaaagaggtactttggccaaatacgccaagttggtcagcgatgcatctaagggatgtgttacagatttataa

SEQ ID NO: 394 - protein, 589 aa, Candida albicans
MSFVKSCRGCLRTFATSTIKHEKKLNKYSSIVTGDPSQGASQAMLYATGFSDEDFDRAQIGVGSVWWSGNPCNMHLMELNNRCSESVNKAGLKAMQFNSIGVSDGITNGTEGMKYSLQSREIIADSFETMTMAQLYDGNIAIPSCDKNMPGVLMAMGRHNRPAIMVYGGTILPGSPTCGTQNPAVADKIDIISAFQSYGQYLSKQINNEERIDIVKHACPGPGACGGMYTANTMASASEVLGLTLPFSSSSPAVSKEKAEECANVGFALKNLLELDLKPRDIVTKKSFENAIAYIIATGGSTNAVLHLIAIASSFDITITVDDFQRISDNTPLLADFKPSGKYVMADLQNVGGTPAVMKYLIKEGIIDGTQLSVTGKTINENLAKLADLPEGQDIVRPVSNPLKPSGHLQILKGTLAPGSAVAKITGKEGTYFKGKARVFNDEGAFIVALENGEIKKGEKTVCVIRYEGPKGGPGMPEMLKPSSALMGYGLGKDVALLTDGRFSGGSHGFLIGHIVPEAAEGGPIALVEDGDIIVIDADNNKIDLLVEPDVLTERRKHWTPPEPRYKRGTLAKYAKLVSDASKGCVTDL

SEQ ID NO: 395 - DNA, 1815 bp, Pichia stipitis
atgagttttttatttaaggctgctgccgcacgccgtgttgcctccaagtcgcctgctgctgtggccagatcgttttctgtctctgctactcaatgtgaaaagaaattgaacaagtactcttcgattgtcactggtgatccctcccagggtgcttcgcaagccatgctctatgccacaggtttcgacgatgccgacttcaacagagcccagatcggtgtgggctcagtttggtggtcaggtaatccttgcaacatgcacttgatggagttgaacaacaagtgtactgaatcagtcaacagagctggtttgaagggaatgcaattcaactcgattggtatttccgatgggatcactaacggaactgaaggaatgagatactctcttcaatctcgtgaaattattgctgactcgttcgaatccatgatgcttggtcaattgtacgatggtaacattgccattccatcctgtgacaagaatatgcctggtgtcttgattgctatggccagacacaacagaccttctattatggtctatggtggtacaatcttgccaggtcaaactacttgcggaaccaacaacccagctatcgccgacaaaattgatatcatctcagctttccagtcgtatggacagtacttgaccaagtccatcactaacgaagaaagaaaggatatcgttagacacgcctgtcctggtcctggtgcctgtggtggtatgtatactgctaacaccatggcatctgcagctgaatgtcttggtatgtctttgccctattcatcttcggctccagccgtctcaaaggaaaaggatgctgagtgtgccaacatcggtcaagccatcaagcacttgttggagatcgacttgaagccccgtgatattttgactaagaaatctttcgaaaacgctatcgcttatatcattgctactggtggatctacgaatgctgtattgcacttaattgccattgcttcctcagctgatattgatcttaccgtagatgatttccagagaatctccgactccactccgttgttggcagacttcaagccatcgggacaattcgtaatggcagacttacagaagtacggtggtactccagccgtgatgaaattcttgatgaacgaaggcttcattgacggagaccagtacactgtcactggtaagaccatcaaggaaaatttggcttccgtcaaggacttgcctgctgatcagcctatcatcagaccagtcagcaaccccttgaagacaagcggtcacttgcaaatcttgaagggttccttggctccaggttctgctgtcggtaagatcaccggtaaggaaggtacctacttcaagggtaaggctcgtgtctttgatgacgaaggagacttcattgtcgccttggagaagggtgagattaagaagggtgaaaagaccgtctgtgtcatcagatacgaaggtccaaaaggaggccccggtatgcctgaaatgttgaagccttcctcggccttgatgggttatggtttaggtaaagatgttgctcttttgacagacggtaggttctctggtggatcccacggcttcttgattgggcacattgttcctgaagctgctgaaggtggacctatcggtttggtgtacgatggtgacgaaatcgtcattgatgccgaaaacaacaagatcgacttgttagtagacgaagctgtgttggctgaaagaagaaagttatggactgctcctgagccaagatacaccaggggtactttggccaagtacgccagattggtcagtgacgcttctgctggatgcgttaccgacttgccaataaagaattaa

SEQ ID NO: 396 - protein, 604 aa, Pichia stipitis
MSFLFKAAAARRVASKSPAAVARSFSVSATQCEKKLNKYSSIVTGDPSQGASQAMLYATGFDDADFNRAQIGVGSVWWSGNPCNMHLMELNNKCTESVNRAGLKGMQFNSIGISDGITNGTEGMRYSLQSREIIADSFESMMLGQLYDGNIAIPSCDKNMPGVLIAMARHNRPSIMVYGGTILPGQTTCGTNNPAIADKIDIISAFQSYGQYLTKSITNEERKDIVRHACPGPGACGGMYTANTMASAAECLGMSLPYSSSAPAVSKEKDAECANIGQAIKHLLEIDLKPRDILTKKSFENAIAYIIATGGSTNAVLHLIAIASSADIDLTVDDFQRISDSTPLLADFKPSGQFVMADLQKYGGTPAVMKFLMNEGFIDGDQYTVTGKTIKENLASVKDLPADQPIIRPVSNPLKTSGHLQILKGSLAPGSAVGKITGKEGTYFKGKARVFDDEGDFIVALEKGEIKKGEKTVCVIRYEGPKGGPGMPEMLKPSSALMGYGLGKDVALLTDGRFSGGSHGFLIGHIVPEAAEGGPIGLVYDGDEIVIDAENNKIDLLVDEAVLAERRKLWTAPEPRYTRGTLAKYARLVSDASAGCVTDLPIKN

SEQ ID NO: 397 - DNA, 1705 bp, Yarrowia lipolytica
ctacgctactaaggcgcacactttgaacaagttctccaagatcatcacggagcccaagtcgcagggagcctctcaggctatgctgtacgcctgcggcttcaacgaggccgatctgggcaagccccaggttggtgtcgcctccgtctggtggtccggaaacccctgcaacatgcacctgcttgatctcaacttcaaggtcaaggagggcatcgagaagcacaacctcaaggccatgcagttcaacactattggtgtgtctgatggtatttctatgggtaccaagggtatgcgatattctctgcaatctcgagacatgattgctgactccattgagactctcatgatggcccagcactacgacgccaacatctccatcccgggctgtgacaagaacatgcccggtgttctcatggccatgggccgagtcaaccgaccctccatcatgctgtacggaggaaccatccaccccggaaaggccgagactcgaaagggcgaggacattgatattgtttccgccttccaggcctacggacagtacattgccggcggcatctctgagaccgagcgagccgatgttattcgacacgcctgccccggtcagggagcctgtggaggtatgtacactgctaacaccatggcttctgccgcagaggtgcttggtatgactctgcctggctcctcctccgctcccgccatctccaaggagaagatggccgagtgtgaggctctgggacctgccatcaacaagctgctggagatggacctcaagcctaaggatatcatgacccgacaggcctttgagaacgctattgcttacatcattgccactggaggctccaccaacgccgttctccatctgctggctatcgctcacaccgtcgacgttcctttgaccattgacgacttccagcgaatctccgataacactcctctgctcgccgacttcaagccctccggagctcacgtcatggccgatctgcagaagtggggtggaacccccgccgtcatcaagatgctcattgagcagggtttcattgatggctctcccatgacctgttccggagagtctctcaaggacaccgtcgccaagtacccctctctccccaaggagcaggatatcttcgcctctgttgacgctcccctcaagccctctggtcatctgcagattcttaagggctcccttgctcccggtggatccgtcggaaagatcaccggaaaggagggaacattcttcaagggtaccgcccgatgtttcgacgaggaggacctgttcattgaggctctggagaagggcgagatcaagaagggcgagaagacctgtgtcattattcgatacgagggccccaagggaggacccggtatgcccgagatgctcaagccctcttctgccctgatgggatacggtctgggcaaggatgttgctctgctgaccgacggacgattctccggaggatctcatggtttcctcattggtcacattgtccccgaggcttacgagggaggtcccattggtctggttgaggacggcgatgagatcatcatcgacgctgacaacaacatcatcgacctgcttgttgatgagaagaccatggctgagcgaaaggccaagtggactccccccgctcctcgatacacctctggaaccctgcacaagtactccaagcttgtgtccgacgcctccactggctgtatcactgacgcctaa

SEQ ID NO: 398 - protein, 567 aa, Yarrowia lipolytica
YATKAHTLNKFSKIITEPKSQGASQAMLYACGFNEADLGKPQVGVASVWWSGNPCNMHLLDLNFKVKEGIEKHNLKAMQFNTIGVSDGISMGTKGMRYSLQSRDMIADSIETLMMAQHYDANISIPGCDKNMPGVLMAMGRVNRPSIMLYGGTIHPGKAETRKGEDIDIVSAFQAYGQYIAGGISETERADVIRHACPGQGACGGMYTANTMASAAEVLGMTLPGSSSAPAISKEKMAECEALGPAINKLLEMDLKPKDIMTRQAFENAIAYIIATGGSTNAVLHLLAIAHTVDVPLTIDDFQRISDNTPLLADFKPSGAHVMADLQKWGGTPAVIKMLIEQGFIDGSPMTCSGESLKDTVAKYPSLPKEQDIFASVDAPLKPSGHLQILKGSLAPGGSVGKITGKEGTFFKGTARCFDEEDLFIEALEKGEIKKGEKTCVIIRYEGPKGGPGMPEMLKPSSALMGYGLGKDVALLTDGRFSGGSHGFLIGHIVPEAYEGGPIGLVEDGDEIIIDADNNIIDLLVDEKTMAERKAKWTPPAPRYTSGTLHKYSKLVSDASTGCITDA

SEQ ID NO: 399 - DNA, 1752 bp, Candida glabrata
atgtcctccagactaacttttgctaggaagttctccagcacaagaaatgttgcaaagaaactgaataaatactcatatatcatcactgagcctaaggaccaaggtgcctctcaggctatgttgtatgccactggtttcaacaaggatgatttcagcaaagcgcaagttggtgttggttcttgttggtggtctggtaacccatgtaacatgcatctattggatttgaaccacagatgttcccaatccatcgagaaagccggtatgaaaggtatgcaatttaacacaattggtgtctctgacggtatctcgatgggtactaaaggtatgagatattctttacaaagtagagaaattatcgcagactctttcgagactatcatgatggcacaacactacgatgccaatattgctattccatcctgtgacaagaatatgcctggtgttatgatggctatgggtagacacaacagaccatctattatggtttatggtggtaccattatgccaggtcacccaacttgtggctccaagaacattccagagaacattgatgttgtctctgctttccaatcctacggtcaatacatctcgaagcaattcaatgaagaagagagaagtgatgttgtacaacactcttgtccaggtcctggctcttgtggtggtatgtacaccgccaacaccatggcctctgctgccgaagttttaggtatcactatgccaaactcttctgctttcccagctgtttctgctgaaaagattgctgaatgtgacaacattggtgctgctatcaagaacactatggaacttggtattaccccacgtcaaatcttcaccaaggaatcctttgaaaacgctatcacttacgtcattgctactggtggttccactaacgcagttcttcacttggtagctattgcacactctgctggtgtcaagatcaccccagatgatttccaaaggatcagtgacaagacaccattgctaggtgacttcaagccatctggtaagtatgtcatggccgatttgattaaggtcggtggtactcaaagtgtcatcaagttcttgtatgacaacggtttcttatacggtgacgccttaactgttactggtgaaactttggctgagcgtgccaagaaagccaagggtctaagtgaaactcaagacattattagaccattgtcaaacccaattaagccaagtggccatctacaaattctatacggttctcttgctccaggtggttctgttggtaagattactggtaaggaaggtacttacttcaaaggtaaggctcgtgttttcgaagaagaagacgctttcatctctgcattggagaatggtgaaatcaagaaaggtgaaaagacagttgttattatcagatatgaaggtccaaagggtggtccaggtatgccagaaatgttgaagccatctagtgcactaatgggttatggtctaggtaaagatgttgccttgctaactgatggtagattctctggtggttctcatggtttcttgattggtcacattgttccagaagctgccgaaggtggtccaattggtttggtcagagatggtgatgaaattgtgattgatgcagacaacaacaagattgacctcctaatctctgaatctgagatgtctcaacgtaaggccgaatggaaacctccagccccacgttacaacaggggtactctatccaaatatgctaagttagtctctaatgcctcccaaggttgtgttacagacgcttaa

SEQ ID NO: 400 - protein, 583 aa, Candida glabrata
MSSRLTFARKFSSTRNVAKKLNKYSYIITEPKDQGASQAMLYATGFNKDDFSKAQVGVGSCWWSGNPCNMHLLDLNHRCSQSIEKAGMKGMQFNTIGVSDGISMGTKGMRYSLQSREIIADSFETIMMAQHYDANIAIPSCDKNMPGVMMAMGRHNRPSIMVYGGTIMPGHPTCGSKNIPENIDVVSAFQSYGQYISKQFNEEERSDVVQHSCPGPGSCGGMYTANTMASAAEVLGITMPNSSAFPAVSAEKIAECDNIGAAIKNTMELGITPRQIFTKESFENAITYVIATGGSTNAVLHLVAIAHSAGVKITPDDFQRISDKTPLLGDFKPSGKYVMADLIKVGGTQSVIKFLYDNGFLYGDALTVTGETLAERAKKAKGLSETQDIIRPLSNPIKPSGHLQILYGSLAPGGSVGKITGKEGTYFKGKARVFEEEDAFISALENGEIKKGEKTVVIIRYEGPKGGPGMPEMLKPSSALMGYGLGKDVALLTDGRFSGGSHGFLIGHIVPEAAEGGPIGLVRDGDEIVIDADNNKIDLLISESEMSQRKAEWKPPAPRYNRGTLSKYAKLVSNASQGCVTDA

SEQ ID NO: 401 - DNA, 1815 bp, Chlamydomonas reinhardtii
atgtcgtcgactgcgaccatgcccggccagcgctcggccatgaaggccgctggcgcccagagccgccgtgccgtgaaggtgatggccgtgtccgctccggagaagccgtcgtcgtccgccccggccgtcccggcaggcctgaacaagttcagcagccgcatcacgcaacccaagtaccagggcgcgtctcaggccatgctgttcgctaccggtctgcgggaggaggacatgatcaagccgcaggtgggcatctcctcggtgtggtacgagggcaacccttgcaacatgcacctgatggacctggcggcggaggtgaagaagggcgtggaggccatgggcatggtgggcttccgcttcaacaccattggtgtcagcgacggcatttccatgggcaccgacggcatgagcttcagcctgcagagccgcgacctgattgccgactccattgagacggtcatgagcgcgcagtggtacgacgccaacatctcgctgcccggctgcgacaagaacatgcccggcacgctgatggccatggcccgcctgaaccgcccctcgctcatgatctacggcggcactatcaagcccggccacagccgcatggacggctccgtgctggacatcgtgtccgccttccagagctacggcgcctactcggccggcctgatcaacgaggcccagcgtgtggacattgtgcgcaacagctgccctggcgctggcgcgtgcggcggcatgtacactgccaacaccatggcctcggccattgaggctctgggcatgaccctgccctacagctcgtccatccccgctgaggacccgctgaagaaggacgagtgccgcatggccggccgctacatgctggagctgctcaagtccgacctgaagcctctggacatcatgacctacaaggcctttgagaacgccatggtgctggtcatggccaccggcggctccaccaacgccgtgctgcacttcatcgccatggcgcgcgcctgcggcgtgcccctgaccctggacgacttccagcgcgtgtctgaccgcacgcccttcatctgcgacctcaagccctcgggccgctacgtcatggaggacatccacaaggtgggcggcacccccgccgtgctgaagtacctggactccaagggctacatcaaccgcgactgcatgaccgtcactggcaagaccatgggcggcaacctggcggaggtgccggagctgcgtgcgggccaggacgtggtgctgcccgtggagaagcccatcaagcagactggccacatccagatcctgtacggcaacctggccccggagggcagcgtggccaagatcactggcaaggagggcctgctgttcgagggcgaggcgctggtgtttgacaacgaggaggacatgatcaccatggtgggcgccgagcccaacaagttccgcggcaaggtggtggtgatccgctacgagggccccaagggcggccccggcatgcccgagatgctcacgcccacctccgccatcatgggcgccggcctgggcaaggagtgcgcgctcatcaccgacggacgcttcagcggcggcagccacggcttcgtgatcggccacgtcacgcccgaggcgcaggtcggcggccccatcgccctggtcaagaacggcgacaagattgtgattgatgtggagaagcgcgtgatggacatgaagatctccgaccaggagctggccgcgcgcaaggctgcctggaaggcgcccccgctgaaggccaccagcggcaccctgtacaagtacatcaagaacgtgtcgtcggcgtccactggctgcgtcaccgactcgtaa

SEQ ID NO: 402 - protein, 604 aa, Chlamydomonas reinhardtii
MSSTATMPGQRSAMKAAGAQSRRAVKVMAVSAPEKPSSSAPAVPAGLNKFSSRITQPKYQGASQAMLFATGLREEDMIKPQVGISSVWYEGNPCNMHLMDLAAEVKKGVEAMGMVGFRFNTIGVSDGISMGTDGMSFSLQSRDLIADSIETVMSAQWYDANISLPGCDKNMPGTLMAMARLNRPSLMIYGGTIKPGHSRMDGSVLDIVSAFQSYGAYSAGLINEAQRVDIVRNSCPGAGACGGMYTANTMASAIEALGMTLPYSSSIPAEDPLKKDECRMAGRYMLELLKSDLKPLDIMTYKAFENAMVLVMATGGSTNAVLHFIAMARACGVPLTLDDFQRVSDRTPFICDLKPSGRYVMEDIHKVGGTPAVLKYLDSKGYINRDCMTVTGKTMGGNLAEVPELRAGQDVVLPVEKPIKQTGHIQILYGNLAPEGSVAKITGKEGLLFEGEALVFDNEEDMITMVGAEPNKFRGKVVVIRYEGPKGGPGMPEMLTPTSAIMGAGLGKECALITDGRFSGGSHGFVIGHVTPEAQVGGPIALVKNGDKIVIDVEKRVMDMKISDQELAARKAAWKAPPLKATSGTLYKYIKNVSSASTGCVTDS

SEQ ID NO: 403 - DNA, 1704 bp, Ostreococcus lucimarinus
atgcccgacggcgacgcgagcgatttgaacaagtggtcgagaaagatcacgcaaccgaagagccaaggagcgtcgcaggcgatgctgtacgccacgggcctgacggaggccgatatgaacaaaccgcagatcggcgtgtcctcggtgtggtggcagggaaacccttgtaacaaacacttgctggacctggcgggtaaagtggcggaaggcgtcaaggcggcggatatggtgagctttcagtttaacaccgtgggggtgtcggacgggatttccatgggtacgccgggcatgtccttctcgttgcaatcgcgggatttgatcgcggatagcatcgagaccgtgatgggtggacagtggtacgacggaaatatttctctcccggggtgcgataagaacatgccgggtacgatcatggccatgggtcgattgaaccgcccgtcgctgatgatttacggcggtaccattcgccctggccactccgccgtggatggtggcacactcgatatcgtatccgcgttccaatcgtacggacagttcgttaccggcgctatcacggaggaacagcgcaaagacatcgtgcgtaactcttgcccgggctctggcgcgtgcggcggcatgtacaccgccaacaccatggccagctgcatcgaggctctcggcatgactcttccgtattcttcctccattcccgcggaagatcctctcaagatggatgaatgtttcatggctggcgctgcgatgaagcatttgctcgaaatcgacctgaagccgcgtgacatcatgactcgcgcggcgttcgaaaacgccatggtcaccgtcatcgctctcggcggttccaccaacgcggttcttcacttgatcgcgatggcgcactctgtcggcatcaaattgactctggacgacttccaagccgtctccaacaagacgccgttcatcgctgacttaaagccgtccggtaagtacgtcatggaggacgtccacaaggttggcggcactccggcggtgttgaagtatttgatgtctgaaggcatgattgacggttcttgcatgactgtcaccggtaagaccctcgccgagaacctcgccatctgcccggatttgacgccggggcaagatgttattctcccggtgagcacgcccatcaagaagactggtcacttgcaatgcttgtacggcaacatcgcccagggaggctccgtggcgaagatcaccggtaaggaaggcttgtactttaaaggcttcgcgaagtgctacgatagcgaagaggaaatgctcgaggccttggcggcagactccgagtctttcaagggtagcgtcatcgtcattcgctacgaaggtccgaagggtggtccgggcatgccggagatgctcacgccgacgtcggccatcatgggtgccggtctcgggaacgactgcgcgctcatcacggatggtcgattctccggtggctcgcacggtttcgtcatcggtcacgttacgccggaagcgcaagttggtggtaacatcggtttgatcaaggacggtgatatcatcgaaattgatgccgaagttcgcaccatcaacgcgccggatgtcaccgacgccgagtgggaaaagcgtcgagcggcgtggaaggcgccgcctttggaagcgacgtcgggtacgctctacaagtactgcaagctcgtcgccagcgcttcggaaggctgcatcacggacttgtga

SEQ ID NO: 404 - protein, 567 aa, Ostreococcus lucimarinus
MPDGDASDLNKWSRKITQPKSQGASQAMLYATGLTEADMNKPQIGVSSVWWQGNPCNKHLLDLAGKVAEGVKAADMVSFQFNTVGVSDGISMGTPGMSFSLQSRDLIADSIETVMGGQWYDGNISLPGCDKNMPGTIMAMGRLNRPSLMIYGGTIRPGHSAVDGGTLDIVSAFQSYGQFVTGAITEEQRKDIVRNSCPGSGACGGMYTANTMASCIEALGMTLPYSSSIPAEDPLKMDECFMAGAAMKHLLEIDLKPRDIMTRAAFENAMVTVIALGGSTNAVLHLIAMAHSVGIKLTLDDFQAVSNKTPFIADLKPSGKYVMEDVHKVGGTPAVLKYLMSEGMIDGSCMTVTGKTLAENLAICPDLTPGQDVILPVSTPIKKTGHLQCLYGNIAQGGSVAKITGKEGLYFKGFAKCYDSEEEMLEALAADSESFKGSVIVIRYEGPKGGPGMPEMLTPTSAIMGAGLGNDCALITDGRFSGGSHGFVIGHVTPEAQVGGNIGLIKDGDIIEIDAEVRTINAPDVTDAEWEKRRAAWKAPPLEATSGTLYKYCKLVASASEGCITDL

SEQ ID NO: 405 - DNA, 1695 bp, Vitis vinifera
atgcaagcagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcgacctagtattatggtttatggtggagctatcaagcctggtcattttcaaggccatacttacgacataatatctgcctttcaggtttatggagagttcgtcagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaaggtctgttggtctgcagttaactcttgatgattttcagaaagtaagtgatgaggttccattccttgctgatcttaagcccagtggcaaatacgtcatggaggacatacacaagattggaggaacaccggcaatcattcgcttccttttggaaaatgggtttttagatggggattgtataacagttactgggaagacattggctgaaaatgcagaactttttccttctttgcccagagatcagcaaataataagaccgttggcaaaccccataaagaagactggacacctccaaactttatatggaaatcttgcaccagagggttctgttgcaaaaattactggaaaagaagggctatatttctctggtcctgcacttgtctttgaaggtgaggaagctatgattgcagctatagcagagaatcctatgagctttaaggggaaagtagttattattagaggagagggacccaagggggggccaggaatgcctgaaatgttgactccaacaagcgcaataatgggagcaggtcttgggaaggatgttgctttgttgactgatggtaggttttcaggaggttcacatggatatgttgttggccacatatgtcctgaagcacatgtacattttcttttccttcatccagttttatttttttatttttttgatcagaaacgaagaagattatattaa

SEQ ID NO: 406 - protein, 564 aa, Vitis vinifera
MQAALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKPGHFQGHTYDIISAFQVYGEFVSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARSVGLQLTLDDFQKVSDEVPFLADLKPSGKYVMEDIHKIGGTPAIIRFLLENGFLDGDCITVTGKTLAENAELFPSLPRDQQIIRPLANPIKKTGHLQTLYGNLAPEGSVAKITGKEGLYFSGPALVFEGEEAMIAAIAENPMSFKGKVVIIRGEGPKGGPGMPEMLTPTSAIMGAGLGKDVALLTDGRFSGGSHGYVVGHICPEAHVHFLFLHPVLFFYFFDQKRRRLY

SEQ ID NO: 407 - DNA, 1839 bp, Vitis vinifera
atgcaagtagctctgataaccccttctcctcgcgccattcccaccggttccatcactgccacgagaaccacaattccccctcatgtgcgcctcgtgtctgtccgagcatcgaccgaggtagcccaatcgccgccacccgcagtgaaagagacggcccacaagctcaacaagtacagctctcatgtcaccgagcccaagtcccagggcggctcacaagccatcctctatggcgtgggtctctcggatgaggacatgcacaagcctcaaatcggtatatcatcggtttggtacgagggcaacacctgcaacatgcatttgttgaagctttcagaggctgtgaaggagggggtgagagatgccggcatggttgggttcaggttcaacactgttggtgtcagcgatgccatctcaatgggcacgagaggcatgtgctatagcttgcagtctagggatttgattgctgatagtattgagacggtcatgtctgctcagtggtatgatggcaacatttctattcccggttgtgacaaaaatatgccaggtacaataatggcaatgggacggctcaatcggcctagtattatggtttatggtggagctatcaagaggcagattgacaattataattgggatcccaatcataccatcctgtgtagtgtggcacaccactttatactgagatatgaaatgttgtatgaagtcatctttgagaaatggcatgatcctggtcattttcaaggccatacttacgacataatatctgcctttcagctatggtctgaaggaggtgtatgtgtagtatcacttgtcccatggtttatggagagttcgtccagtgggtccataactgatgaacagaggatgaatgttgtccgaaattcatgcccaggagcaggagcttgtggtggaatgtatacagccaatacgatggcttctgctattgaagttatgggaatgtctcttcccttcagctcttcaacaccggctgaagacccattgaagttgcatgagtgccatttggctggaaaatatcttctggatttgataaaaatggacttaaaaccacgagatattatcactatgaagtcactacggaatgctatggttgttgtcatggcattgggtggatctaccaatgctgtattacatttaattgccattgcaagaattgctcatgataagattcttggcaggtctgttggtctgcagttaactcttgatgattttcagaaagtaagtgatgaggttccattccttgctgatcttaagcccagtggcaaatatgtcatggaggacatacacaagattggaggaacaccggcaatcattcgcttccttttggaaaatgggtttttagatggggattgtataacaggtcctgcacttgtctttgaaggtgaggaagctatgattgcagctatagcagagaatcctatgagctttaaggggaaagtagttattattagaggagagggacccaaggggggcccaggaatgcccgaaatgttgactccaacaagcgcaataatgggagcaggtcttgggaaggatgttgctttgttgactgatggtaggttttcaggaggttcacatggatatgttgttggccacatatgtcctgaagcacatgaaggtggtcccattggtctcattgaaaatggagatatcatcacaattgatgtccaaaaaaggagaatggatgtccagctgacagatgaagagatgaatgagcgaagaaagaaatggagtcccccaccatataaggctaaccaaggagttctatacaagtacatcaagaacgtaaaatcggcttcagatgggtgtgtgacggatgaataa

SEQ ID NO: 408 - protein, 612 aa, Vitis vinifera
MQVALITPSPRAIPTGSITATRTTIPPHVRLVSVRASTEVAQSPPPAVKETAHKLNKYSSHVTEPKSQGGSQAILYGVGLSDEDMHKPQIGISSVWYEGNTCNMHLLKLSEAVKEGVRDAGMVGFRFNTVGVSDAISMGTRGMCYSLQSRDLIADSIETVMSAQWYDGNISIPGCDKNMPGTIMAMGRLNRPSIMVYGGAIKRQIDNYNWDPNHTILCSVAHHFILRYEMLYEVIFEKWHDPGHFQGHTYDIISAFQLWSEGGVCVVSLVPWFMESSSSGSITDEQRMNVVRNSCPGAGACGGMYTANTMASAIEVMGMSLPFSSSTPAEDPLKLHECHLAGKYLLDLIKMDLKPRDIITMKSLRNAMVVVMALGGSTNAVLHLIAIARIAHDKILGRSVGLQLTLDDFQKVSDEVPFLADLKPSGKYVMEDIHKIGGTPAIIRFLLENGFLDGDCITGPALVFEGEEAMIAAIAENPMSFKGKVVIIRGEGPKGGPGMPEMLTPTSAIMGAGLGKDVALLTDGRFSGGSHGYVVGHICPEAHEGGPIGLIENGDIITIDVQKRRMDVQLTDEEMNERRKKWSPPPYKANQGVLYKYIKNVKSASDGCVTDE

SEQ ID NO: 409 - DNA, 1827 bp, Arabidopsis thaliana
atgcaagccaccatcttctctccacgcgccactctcttcccctgtaaacctctcctcccttcccacaatgtcaactctcgccgtccctcaatcatctcctgctccgcccaatccgtaaccgctgatccttcaccacctatcactgacaccaataagctcaacaaatacagctcaagaatcactgaacccaaatcccaaggtgggtctcaagcaattcttcacggtgttggtttatcagacgacgatttgctaaaaccccagattggtatctcgtcggtttggtatgaagggaacacttgtaacatgcatttgctgaaattgtctgaggctgtgaaagaaggagttgaaaatgcaggaatggttgggtttaggtttaatactattggtgtgagtgatgctatttcgatgggaacgagagggatgtgttttagtttgcaatctagggatttgattgctgatagtattgagactgttatgagtgctcagtggtatgatggtaacatatctattcccggttgtgataaaaatatgcctggaactattatggctatgggaaggcttaacagaccagggattatggtttatggtggaaccattaagcctggccattttcaagacaagacatatgacattgtatctgctttccagagttatggagaatttgttagtggctccataagtgatgaacagagaaagactgtcctccatcattcatgtcctggagctggagcctgtggtggcatgtacacagcgaatacaatggcttctgctatcgaagcaatgggaatgtcccttccttacagttcttcaatacctgctgaagacccattgaagttggacgagtgtcgcttagcaggaaaatatcttctagaattgctaaagatggacttaaaaccccgtgacattatcactccaaaatcacttcgtaatgcaatggtttccgtcatggcccttgggggatcgacaaatgcagtattgcatctaattgctattgcaaggtctgttggtttggagttgactcttgacgattttcagaaagttagcgatgcggttccatttctagcagatcttaaacccagtgggaagtatgttatggaggatatacataagataggtggtacgccagctgttctccgctatttattagagctaggattgatggatggtgattgtatgacagtgacagggcagactttggctcaaaatttagaaaacgtcccaagcttaacagaagggcaggagataattagacctctgtcaaatccaatcaaggagactggacacatacaaattttgagaggagaccttgcaccagatggttctgtagcaaaaattaccggcaaagagggcttatatttctctggtcctgcacttgtatttgaaggagaggaatctatgttggctgctatatcagcagacccaatgagttttaagggaactgtggttgttatcagaggagaggggcctaaaggaggtccaggtatgcctgagatgttgacaccgacaagtgcaataatgggtgccggtcttggaaaggaatgtgcattactgactgatggtaggttctctggtgggtcacacggttttgttgttggccacatttgccctgaagctcaggagggtggtccgatcggtctgatcaagaacggagacataatcaccattgacataggaaagaagagaatagacacacaagtctcacccgaagaaatgaatgaccgtagaaagaaatggactgctcctgcatacaaggttaaccgcggagtcctatataagtacatcaagaacgtgcaatcggcttcagatggatgtgtgactgacgagtaa

SEQ ID NO: 410 - protein, 608 aa, Arabidopsis thaliana
MQATIFSPRATLFPCKPLLPSHNVNSRRPSIISCSAQSVTADPSPPITDTNKLNKYSSRITEPKSQGGSQAILHGVGLSDDDLLKPQIGISSVWYEGNTCNMHLLKLSEAVKEGVENAGMVGFRFNTIGVSDAISMGTRGMCFSLQSRDLIADSIETVMSAQWYDGNISIPGCDKNMPGTIMAMGRLNRPGIMVYGGTIKPGHFQDKTYDIVSAFQSYGEFVSGSISDEQRKTVLHHSCPGAGACGGMYTANTMASAIEAMGMSLPYSSSIPAEDPLKLDECRLAGKYLLELLKMDLKPRDIITPKSLRNAMVSVMALGGSTNAVLHLIAIARSVGLELTLDDFQKVSDAVPFLADLKPSGKYVMEDIHKIGGTPAVLRYLLELGLMDGDCMTVTGQTLAQNLENVPSLTEGQEIIRPLSNPIKETGHIQILRGDLAPDGSVAKITGKEGLYFSGPALVFEGEESMLAAISADPMSFKGTVVVIRGEGPKGGPGMPEMLTPTSAIMGAGLGKECALLTDGRFSGGSHGFVVGHICPEAQEGGPIGLIKNGDIITIDIGKKRIDTQVSPEEMNDRRKKWTAPAYKVNRGVLYKYIKNVQSASDGCVTDE

SEQ ID NO: 411 - DNA, 1785 bp, Oryza sativa
atgcagtcgcttgccctcacctccccctcccttccggcgccggcgaccgcatccggccgccgccgccgccgcctggagcgcatccgcgccaccgcggtgtccgacgagccgaagctgaacaagtacagcgcgcgcatcacggagcccaagtcgcagggggcgtcgcaggcggtgctctacggcgtggggctcaccgacgccgacctccgcaagccgcaggtgggcgtctcctctgtctggtacgagggcaacacctgcaacatgcaccttctccgcctcgccgaggccgtcagggacggcgtccgcgaggccggcatggtggccttccgcttcaacaccgtcggggtcagcgacgccatctccatgggcacccggggcatgtgctacagcctccagtcgcgcgacctcatcgccgacagcatcgagaccgtcatgggcgcgcagcactacgacgccaacatctccattcctggatgcgacaagaacatgccaggaacaataatggcaatggggcggctgaaccgaccaagtatcatgatatatggtggaactattaagcctggtcattttcagggtaattcttatgacatagtatctgctttccagtgctatggagaatttgttaccggatcaatcagtgatgagcaaagaaagaatgtgctccgcaactcatgcccaggagcaggtgcgtgtggtggtatgtacaccgcgaacacaatggcatccgccatcgagaccatgggtatgagccttccgtacagttcttcaacccctgctgaagacccactaaagctagaggaatgccgtcttgctgggaagtatcttttagaattgttaaagatggatttgaagcctgaagacattatcactgagaaatctttgcggaacgcaatggtcattgtcatggcacttggtgggtctactaatgctgttttgcatttaattgctatcgctaggtctgtaggtctgcaattaactcttgatgattttcagaaggtcagtgaccaagttcctttccttgcggaccttaagcctagtggcaaatatgtcatggaggatctgcataagattggtggaacacctgcagtaattcattatcttctggagcaaggtcttcttgatggtgattgtatgaccgtcactgggaaaactctagcggaaaatgctaaaatcttccctcctctgtccgaaggacagcaaataataaggcccctggacaacccaatcaaatcaactggtcatatacaaatactttatggcaatcttgcaccagaaggttctgtagcaaaaattactggcaaagaggggatgtttttctcaggccctgcactagtgtttgagggtgaagaatctatgattacagctatatcagaaaacccagcgaatttcaaggggaaggtagtagtgatacgaggagaaggaccgaaaggtggaccagggatgcctgaaatgctgactccaactagtgcaataatgggtgctggtcttgggaaggagtgtgccctgctgaccgatggcagattttctggaggatcacatggatttgttgtaggccacatttgtcctgaagcacaggagggaggtccaattggtcttgttcaaaacggtgacaaaattaccattgatgttgtgaagagagtaattgatgttgaactgactgaagctgagctggaagaaagacggaggaaatggacgccgccgccacacaaggctgcccgtggagcgctttggaagtacacgaagctcgtgtcccctgcatcaagaggatgcgtcaccgatgagtag

SEQ ID NO: 412 - protein, 594 aa, Oryza sativa
MQSLALTSPSLPAPATASGRRRRRLERIRATAVSDEPKLNKYSARITEPKSQGASQAVLYGVGLTDADLRKPQVGVSSVWYEGNTCNMHLLRLAEAVRDGVREAGMVAFRFNTVGVSDAISMGTRGMCYSLQSRDLIADSIETVMGAQHYDANISIPGCDKNMPGTIMAMGRLNRPSIMIYGGTIKPGHFQGNSYDIVSAFQCYGEFVTGSISDEQRKNVLRNSCPGAGACGGMYTANTMASAIETMGMSLPYSSSTPAEDPLKLEECRLAGKYLLELLKMDLKPEDIITEKSLRNAMVIVMALGGSTNAVLHLIAIARSVGLQLTLDDFQKVSDQVPFLADLKPSGKYVMEDLHKIGGTPAVIHYLLEQGLLDGDCMTVTGKTLAENAKIFPPLSEGQQIIRPLDNPIKSTGHIQILYGNLAPEGSVAKITGKEGMFFSGPALVFEGEESMITAISENPANFKGKVVVIRGEGPKGGPGMPEMLTPTSAIMGAGLGKECALLTDGRFSGGSHGFVVGHICPEAQEGGPIGLVQNGDKITIDVVKRVIDVELTEAELEERRRKWTPPPHKAARGALWKYTKLVSPASRGCVTDE

SEQ ID NO: 413 - DNA, 1767 bp, Physcomitrella patens
atggtggtggcgtcgtcgagcgcggaaggggctgtggccgcgccgcccccgcagtccgtggaggcgccggctgggagcgccacggacagcgcgaagctgaacaagtactcaagccgcgtgacccagcctaaggcgcagggcgcctcgcaggcgattctgtacggggtggggttgtccgaggaggatatgaacaagccgcaggtgggaatctcgtcggtttggtacgagggcaacacgtgcaatatgcatttgctgcatttgtctgaggctgtgaaggagggggtgaaggaggccgggatggtggggttccgattcaacactgtgggagttagtgacgccgtgtccatgggaaccgaggggatgtgctacagcctgcagtcgcgcgatttgattgcggacagtgtggagactgttatgggcgggcagtggtacgacgccaacatttccattccggggtgtgataagaacatgcccggggtggtcatggccatggggcggctgaacaggcccagcattatgatttatgggggcaccatcaagccaggtcattttaacggacagacgctcgacatcgtttcagccttccagagctacggagagtatgtgagcgggtccatctccgaggatgagaggatggacgttgtaaggaattcttgccccggattcggagcttgtggaggaatgtacaccgccaacaccatggcgtccgccattgaagcgctaggcatgtcgctgccgtacagctcttccatccccgccgaggacccgttgaagatcgaggaatgcaaattggccgggaaatacattctggagcttctaaagcgtgacttgaagccgcgtgacattatcacccgaaagtcgctcaacaacgctatggtggttgtcatggcgctcggaggttccacgaatgcggtgcttcatctcatcgccatcgctcgttctgtgggcgttgagctcacattggacgatttccaggacgtgagcgacaagaccccgttcattgctgatcttaaacctagcgggaagtacgtgatggaggatttgcacaaaattggaggcgtgcctgccgtactgaagtacttgttagaaaaagggctaatcgacgggagctgcatgacagtcacggggaagaccatcgctgagaacctcgctgagtgcccgcccctctccgaaggtcagaagatcatcatgcctctcgaaaaccccatcaaaaaaactggtcacttgcaaattctgtggggcaaccttgctccagagggttccgttgctaaaattacaggcaaagaaggcttgtacttttctggccccgcccgtgtatttgagggagaggaagccatgctggacgctatcactgaggaccctcagagcttgaagggtactgtgatcgttatccgaggggagggtcctaagggtggcccgggcatgcctgagatgctcacccccacgagtgctgtaattggagctggacttggcaaggaagtagcgcttctgaccgacggtcgattctctggtggctctcacggcttcgttgttgggcacatctgcccagaagctcaagtaggtggcccgattgggcttgtacgtgatggagacgtgatcaccatcgacgtggagaagaggaaaatcaacgtcgatttgacggcacaagagcttgcggatcgaaaactcctgtggagagctcccccttacaaggcctctcgtggaaccctttacaagtacatcaagaatgtcaaatcagcgtccgaaggttgcgtgactgatgagtga

SEQ ID NO: 414 - protein, 588 aa, Physcomitrella patens
MVVASSSAEGAVAAPPPQSVEAPAGSATDSAKLNKYSSRVTQPKAQGASQAILYGVGLSEEDMNKPQVGISSVWYEGNTCNMHLLHLSEAVKEGVKEAGMVGFRFNTVGVSDAVSMGTEGMCYSLQSRDLIADSVETVMGGQWYDANISIPGCDKNMPGVVMAMGRLNRPSIMIYGGTIKPGHFNGQTLDIVSAFQSYGEYVSGSISEDERMDVVRNSCPGFGACGGMYTANTMASAIEALGMSLPYSSSIPAEDPLKIEECKLAGKYILELLKRDLKPRDIITRKSLNNAMVVVMALGGSTNAVLHLIAIARSVGVELTLDDFQDVSDKTPFIADLKPSGKYVMEDLHKIGGVPAVLKYLLEKGLIDGSCMTVTGKTIAENLAECPPLSEGQKIIMPLENPIKKTGHLQILWGNLAPEGSVAKITGKEGLYFSGPARVFEGEEAMLDAITEDPQSLKGTVIVIRGEGPKGGPGMPEMLTPTSAVIGAGLGKEVALLTDGRFSGGSHGFVVGHICPEAQVGGPIGLVRDGDVITIDVEKRKINVDLTAQELADRKLLWRAPPYKASRGTLYKYIKNVKSASEGCVTDE

SEQ ID NO: 415 - DNA, 1800 bp, Chaetomium globosum
atgctctctccgtctctgctgcgcactggcgctcccagggccctggccatgagccgggtcttgccttttaggaaccagtaccgtctcctatccacaacaccccgccggtatgccgacgagaagctcaaccggatttcctccaagatcacacaaccgaagtcgcagggtgcctcccaggctatgctctacggtaccggcttgaccgaggcagacatgtccaaggcccaggtcggcatctcgtccgtctggtacgagggcaacccctgcaacatgcacctgatggagctctctggccatgtccgcaacagcatcgaaaaggccgggctcgtccctatgcgcttcaacaccatcggtgtttctgacggcatcagcatgggcaccacgggcatgcgctacagcttgcagagcagagagatcatcgccgacagcatcgagacggtcatgcagggccagtggtacgacgccaacgtgtcgctgcccggctgcgacaagaacatgcctggtgtcctgatcgccatgggccgcgtcaacaggcctagcattatggtctacggtggcaccatcaagccgggctgcaccatgaagggcgagcccatcgacatcgtcagcgccttccaggcgtacggccagtacatctcgggcgagatcgacgagaagcagcgcttcgacatcatccgcaacgcctgccctggcggcggcgcctgcggtggcatgtacacggccaacaccatggcctcggcgatcgagaccctcggcatgaccctccctggcagcagcagcttcccggccgaggacgcgcgcaagaaggccgagtgcgagagcgtgggcgaggccatcaagaacctcctccgcgagaacatccggcctagcgacatcctgacccgacaggcgtttgagaacgccatggtcgtcgtcggcgtgctgggcggcagcaccaacgctgtgctgcacctcatcgccatcgccgactcggtcggcatcaagctcactatcgacgacttccaagccgtctcggaccgtatccctttactcgccgatctgaagccctcaggcaagtacgttatggaggacctgttcaagatcggcggcaccccggcgctgctcaagttcctcctcaaggagggcctcctcgacggctcgggcattaccgtgactggtaagaccatgaaggagaacgtcgccgacctgcccggcttccccgcggaccagcccatcatccgccccctaaacaacccgctcaagccgacgggccacatccagatcctgcgcggctcgctcgcccccggcgggtcggtgggcaagatcacgggcaaggagggcctccggttcgagggcacggccaaggtgtacgactacgaggatgccttcatcgaggcgctggagcggggcgagatcaagaagggcgagaagacggtggtggtgatccggtacgagggccccaagggcgggcccggcatgcccgagatgctcaagcccagctcggccatcatgggcgccgggctcggccaggacgtcgccctcatcaccgacggccgcttctccggcggcagccacggcttcctcatcggccacatcgtgcccgaggccatggaaggcgggcccatcggcctagtccgcgacggcgacaagattgtcatcgacgccgacaagcgcgtcctcgacctcgaggtgcccgccgacgaaatggcgcgccgcaaggccgagtggaaggcccccgagcccagggccaagcgcggtaccctgaagaaatacgcctcgctggtcagcgatgccagccaggggtgtgtcaccgacaaatag

SEQ ID NO: 416 - protein, 599 aa, Chaetomium globosum
MLSPSLLRTGAPRALAMSRVLPFRNQYRLLSTTPRRYADEKLNRISSKITQPKSQGASQAMLYGTGLTEADMSKAQVGISSVWYEGNPCNMHLMELSGHVRNSIEKAGLVPMRFNTIGVSDGISMGTTGMRYSLQSREIIADSIETVMQGQWYDANVSLPGCDKNMPGVLIAMGRVNRPSIMVYGGTIKPGCTMKGEPIDIVSAFQAYGQYISGEIDEKQRFDIIRNACPGGGACGGMYTANTMASAIETLGMTLPGSSSFPAEDARKKAECESVGEAIKNLLRENIRPSDILTRQAFENAMVVVGVLGGSTNAVLHLIAIADSVGIKLTIDDFQAVSDRIPLLADLKPSGKYVMEDLFKIGGTPALLKFLLKEGLLDGSGITVTGKTMKENVADLPGFPADQPIIRPLNNPLKPTGHIQILRGSLAPGGSVGKITGKEGLRFEGTAKVYDYEDAFIEALERGEIKKGEKTVVVIRYEGPKGGPGMPEMLKPSSAIMGAGLGQDVALITDGRFSGGSHGFLIGHIVPEAMEGGPIGLVRDGDKIVIDADKRVLDLEVPADEMARRKAEWKAPEPRAKRGTLKKYASLVSDASQGCVTDK

SEQ ID NO: 417 - DNA, 1791 bp, Neurospora crassa
atgctcgctccctcccttctgcgggctcaggcccccagagctctggcttctgcccgtctctccctccgctccctctccaccactccccgccgctacaatgcccaggagaagcagctcaacaaggtgtcggccaacatcacccagcccaagtctcagggtgcttcccaggccatgctctacgccaccggcctcaacgaggacgacatgaacaaggcccaggtcggtatctcgtctgtctggtatgagggcaacccttgcaacatgcaccttctcgacctctccggcctcgtcaaggagtccgttgccaaggctggcctcgtccccatgcgcttcaacaccatcggtgtctcggacggtatctccatgggtaccaccggtatgcgctacagcttgcagtcccgtgagattattgccgactccatcgagaccgtcatgaacggccagtggtacgacgccaacatctccctccccggttgcgacaagaacatgcccggtgtcctcatcgccatgggccgtgtcaaccgcccctccatcatggtctacggtggtaccatcaagcccggctgcaacatgaagggcgagaacatcgatatcgtttccgccttccaggcatacggccagtacatctccggtgagatcgacgagaagcagcgcttcgatatcatccgcaacgcctgccctggtggtggcgcctgcggtggcatgtacactgccaacaccatggccaccgccatcgagaccctcggcatgacccttcccggttcctcctcctaccccgccgagtctcccgagaagaagaacgagtgcttgagcgtcggtgaggccatcaagaacctcctccgcgaggacatccgccccaccgatatccttactcgccaggccttcgagaacgccatgatcgtcgtcaacattcttggcggttccaccaacgccgtcctccacttgattgccatcgccgactccgttggcatcaagctcaccatcgatgacttccaggccgtctccgaccgcactcctttccttgccgacctcaagccttccggcaagtgggtcatggaggaccttagcaagattggcggcacccccgcccttctcaaattcctcctcaaggagggaatcctcgacggctccggcatcacctcgaccggtaagaccatgaaggagaacgtcgagaagttccccgacttccccaccgaccaggccatcatccgccctctgtcgaaccccatcaaggaaaccggacacattcagatcctccgcggctctctcgctcccggcggttccgtcggcaagatcaccggcaaggagggtctccgtttcgagggtaaggctcgctgcttcgactacgaggacggctttattgaggctctcgagcgtggcgagatcaagaagggcgagaagaccgtcgtcgtcatccgctacgagggtcccaagggcggccctggcatgcccgaaatgctcaagccttcgtccgccattatgggctacggtctcggcaaggacgttgccctcatcactgacggccgcttctccggtggttctcacggcttcctcatcggccacattgtgcctgaggctatggagggtggccccattggtctcgtccgcgatggcgacaccatcgtcatcgacgccgagaagaaggttcttgaccttgaggttcctgaggaggagctcgccaagcgccgcaaggagtggaaggctcctgagcccaaggctaagcgtggtactctcaggaagtacgcccagctcgtcaaggatgctagctctggctgcgtcactgacgcttaa

SEQ ID NO: 418 - protein, 596 aa, Neurospora crassa
MLAPSLLRAQAPRALASARLSLRSLSTTPRRYNAQEKQLNKVSANITQPKSQGASQAMLYATGLNEDDMNKAQVGISSVWYEGNPCNMHLLDLSGLVKESVAKAGLVPMRFNTIGVSDGISMGTTGMRYSLQSREIIADSIETVMNGQWYDANISLPGCDKNMPGVLIAMGRVNRPSIMVYGGTIKPGCNMKGENIDIVSAFQAYGQYISGEIDEKQRFDIIRNACPGGGACGGMYTANTMATAIETLGMTLPGSSSYPAESPEKKNECLSVGEAIKNLLREDIRPTDILTRQAFENAMIVVNILGGSTNAVLHLIAIADSVGIKLTIDDFQAVSDRTPFLADLKPSGKWVMEDLSKIGGTPALLKFLLKEGILDGSGITSTGKTMKENVEKFPDFPTDQAIIRPLSNPIKETGHIQILRGSLAPGGSVGKITGKEGLRFEGKARCFDYEDGFIEALERGEIKKGEKTVVVIRYEGPKGGPGMPEMLKPSSAIMGYGLGKDVALITDGRFSGGSHGFLIGHIVPEAMEGGPIGLVRDGDTIVIDAEKKVLDLEVPEEELAKRRKEWKAPEPKAKRGTLRKYAQLVKDASSGCVTDA

SEQ ID NO: 419 - DNA, 1788 bp, Magnaporthe grisea
atgatgtcctcaaacctgctgcgcgccagggtgcccaaggccctggctgccaccaggagccatgcggccctcttctccacaacctcgcgccgcgctgagcaactgaacaagacttcggccaagatcacacagcccaagtcccagggtgcgtcacaggccatgctgtacgccaccggcttgaccgaggaggacatgaacaagccgcaggtcggcatctcgtcggtctggtacgagggcaacccctgcaacatgcacatcctcaagctgtcggagcggatccgcgactccgtcaaggccgccaacctggtccccatgcgcttcaacaccattggagtctcggacggtatcagcatgggcacgaccggcatgcgctattcgctgcagagccgtgagatcatcgccgacagtatcgagaccgtcatgcagggccagtggtacgatgccaacatctccatcccgggctgcgacaagaacatgcccggtgttctcatcgccctcggccgtgtcaaccgccccagtttgatcgtttacggcggtaccatcaagcccggctgcagccaaaagggcgagcccatcgacatcgtcagcgccttccaggcctacggccagtacctgactggtgagatcaccgaggagcagcggttcgacatcatccggaacgcgtgccccggcggtggtgcatgcggtggcatgtacactgccaacactttggcgtcggctatcgagactctgggcatgagcttgccgggaagcagcagcaaccccgcagagcaccccagcaagctggccgaatgtgaccaggttggcgaggccatcaagaacatcctccgtgaggacgtgcgcccccgcgacatcatgacgaggcaggcctttgagaacgccatggttgtagtcagcatccttggtggaagcaccaacgccgtcctgcacctgcttgccgttgccgatgcggtcggtgtcaagcttaccattgacgacttccaagccgtttccgaccggacaccgctcctggcagacctcaagccttcgggcaaatacgtcatggaggatgtacacaagattggtggcacgccatctctcctgcgcttcctggccaaggagggcttgatcgatgcttctggcatcaccgtcactggcaagaccatgaaggagaacttggacaagtaccccgacttcccggccgaccagcccatcatccggcctctcagcaaccccctcaagtccacgggccacatccagatcctccgcggtagtctcgcacccggtggctctgtcggcaagattaccggcaaggagggtcttcagttcactggcaaggcccgctgctacgactgcgaggacgactttatcgagtcgctcgagcgtggcgagatcaagaagggtgagaagacggttgtcatcatccgttacgagggccccaagggtggtcccggcatgcccgagatgctgaagcccagctcggccatcatgggtgccggtctcggcaaggacgttgccctcatcactgacggtcgcttctctggcggttcgcacggattcctcatcggacacgttgtgcccgaggccatggagggcggacctatcgcacttgttcgcgatggcgacaccattactattgatgcggagaagcgggtgatcgacacggacgtgtcggacaagaccatggcggagcgccgcgccgagtggaaggctcccccgatcagggagaccaggggaacgctggccaagtacgcagcgctggttagcgacgcgagcagtggttgcgtgacggacaaggtcgcgcgataa

SEQ ID NO: 420 - protein, 595 aa, Magnaporthe grisea
MMSSNLLRARVPKALAATRSHAALFSTTSRRAEQLNKTSAKITQPKSQGASQAMLYATGLTEEDMNKPQVGISSVWYEGNPCNMHILKLSERIRDSVKAANLVPMRFNTIGVSDGISMGTTGMRYSLQSREIIADSIETVMQGQWYDANISIPGCDKNMPGVLIALGRVNRPSLIVYGGTIKPGCSQKGEPIDIVSAFQAYGQYLTGEITEEQRFDIIRNACPGGGACGGMYTANTLASAIETLGMSLPGSSSNPAEHPSKLAECDQVGEAIKNILREDVRPRDIMTRQAFENAMVVVSILGGSTNAVLHLLAVADAVGVKLTIDDFQAVSDRTPLLADLKPSGKYVMEDVHKIGGTPSLLRFLAKEGLIDASGITVTGKTMKENLDKYPDFPADQPIIRPLSNPLKSTGHIQILRGSLAPGGSVGKITGKEGLQFTGKARCYDCEDDFIESLERGEIKKGEKTVVIIRYEGPKGGPGMPEMLKPSSAIMGAGLGKDVALITDGRFSGGSHGFLIGHVVPEAMEGGPIALVRDGDTITIDAEKRVIDTDVSDKTMAERRAEWKAPPIRETRGTLAKYAALVSDASSGCVTDKVAR

SEQ ID NO: 421 - DNA, 1797 bp, Gibberella zeae
atgctttcccggtcactgctgcgctctagagctgtgggagctttccccctctctgccaggaatcatggccgcttcctgtctaccacctccatccgctccgatgacaagctcaacaagatctcctccaacatcactcagcccaaggcccagggtgcttcccaggctatgctctacgccaccggcctctctgaagctgacatgaacaaggctcaagttggcatctcgtccgtctggtacgagggaaacccttgcaacatgcaccttatggacctctctgcccacgtcaaggagtctgtcgccaaggccggtcttattccctaccgattcaacaccatcggtgtctctgatggtatctccatgggtaccactggtatgcgatattccctccagagccgagagattattgccgatagtgttgagactgtcatgaacggtcaatggtatgacgccaacgtcagcttgcccggttgcgacaagaacatgcccggtgttgccattgccatgggtcgtgtcaaccgtcccagcatcatggtttacggtggtaccattaagcccggttgcaccaagcagggcgagtctatcgatatcgtctctgctttccaggcctacggtcaatacatcaccggcgagatcaccgaggagcagcgattcgacattatccgaaatgcctgccctggtggtggtgcttgtggtggcatgtacactgccaacaccatggctactgccattgagactctgggacttaccctccctggtagcagcagcagccctgctgaggaccccagcaagatcgccgagtgtgaggctgttggacctgctatccgcaacattctcaaggaagatatccgacctcgtgacatcatgactcgccaagcctttgagaatgccatgatcgtcactaccatccttggtggcagcaccaacgctgttctgcatcttatcgcaattgccgactctgtcggtatcaagctcgacatcgaggacttccaaaaggtttccgaccgcactcccttccttgccgacctgaagccctctggaaagtgggtcatggccgatatgcacaagattggtggtactcctgctcttctcaagttcctcttgaaggagggtatcattgacggctctggtatcactgtcactggcaagaccatgaagcagaacgtcgaggagttgcctggattccccgaggatcaaaccatcattcgcccccttagcaaccccattaagcctaccggtcacatccagattctccgtggatccctggctcctggtggctgtgttggtaagatcactggcaaggagggtctccgattcgagggtaaggcccgtgtctacgactccgagcccgccttcatctctagccttgaggctggtgagatcaagaagggtgagaagactgtcgttatcatccgatatgatggacccaagggtggccccggtatgcctgagatgctgaagccttcttctgccattatgggtgctggccttggacaggatgtcgcccttctcactgacggtcgcttctctggtggttctcacggtttcattattggtcacattgtccccgaggcaatggagggtggccctatcgcccttgtcgaggacggtgacaccatcgttatcgacgccgagtctcgtgctatcgacctcgttgttcccgaggcagaggttgatcgccgtcgcaaggcctggaaggctcccgctccccgatacaccaagggcacactcagcaagtacgctcgactggtgaccaacgccagtgagggctgtgtcaccgatagcggtctcaagaactaa

SEQ ID NO: 422 - protein, 598 aa, Gibberella zeae
MLSRSLLRSRAVGAFPLSARNHGRFLSTTSIRSDDKLNKISSNITQPKAQGASQAMLYATGLSEADMNKAQVGISSVWYEGNPCNMHLMDLSAHVKESVAKAGLIPYRFNTIGVSDGISMGTTGMRYSLQSREIIADSVETVMNGQWYDANVSLPGCDKNMPGVAIAMGRVNRPSIMVYGGTIKPGCTKQGESIDIVSAFQAYGQYITGEITEEQRFDIIRNACPGGGACGGMYTANTMATAIETLGLTLPGSSSSPAEDPSKIAECEAVGPAIRNILKEDIRPRDIMTRQAFENAMIVTTILGGSTNAVLHLIAIADSVGIKLDIEDFQKVSDRTPFLADLKPSGKWVMADMHKIGGTPALLKFLLKEGIIDGSGITVTGKTMKQNVEELPGFPEDQTIIRPLSNPIKPTGHIQILRGSLAPGGCVGKITGKEGLRFEGKARVYDSEPAFISSLEAGEIKKGEKTVVIIRYDGPKGGPGMPEMLKPSSAIMGAGLGQDVALLTDGRFSGGSHGFIIGHIVPEAMEGGPIALVEDGDTIVIDAESRAIDLVVPEAEVDRRRKAWKAPAPRYTKGTLSKYARLVTNASEGCVTDSGLKN

SEQ ID NO: 423 - DNA, 1797 bp, Aspergillus niger
atgttcgcgtcgagtatccgatcgagagctctgggattgagcccacgagcccggtttgagaatactcgtcttccatcttccactagcgggcgccgttatagatccgatgagcccctcaaccgaatttcctcgaaaatcacacaacccaaatcccagggtgcttcgcaagcaatgctctacgccaccggcctaacagaggaagacatgtccaagccacaggtcggtatctcctcggtgtggttcgagggtaacccatgcaacatgcacttgcatgacctgtctgccattgtgcgcgattccgtgctccgtgcgggtctggtccctatgcgattcaactcagttggagtgtcggatgggatcagtatgggtacaaagggaatgagatacagcctgcagagccgggagctgatcgctgatggtattgagacggtgatgaatgcccagtggtacgatgcgaatgtgtcgctcccgggttgtgataagaatatgccaggtgtattaatagcgatgggacgcacgaaccgacctagcatcatggtctacggtggcagtatcaagcctggatgcagtgcaaagggccagaaattggacctggtcagtgcattccagtcatatggccagttcatcaccggccagatcgacgagaaggagcggttcgatatcattcgcaatgcatgccccggcagaggtgcatgcggtggcatgtacacggctaatacgctggccacggctattgagactatgggaatgactattcctggtagtagtagttgcccggcagatgatcgcaagaagctagttgagtgcgaaaatattggcgaggtggttaaaaatatgctcagggaagatatcaaacccagggatatcttaacacgtcaagccttcgagaatgcaatgattgtagtgaacgtgctgggtggcagtactaatgctgttttacatctgattgccattgctgactctgtcggtatcaagttgactattgatgacttccaggcagtatctgataagacaccgttcctggctgatttgaagccatctggaaagtatcttatgaatgatctttataatatcggtggcacaccagccctcctgaaatatctcctgaaggagggcttgatcgatggctcaggagttactgttaccggtaaaacaatgaaggaaaatgtagcctcatggcctgattttcctgctgaccaggatatcatccgccccctcaacaaccctatcaaaccatctggccatctccagattcttcgcggatcgctggccccgggcggttccgtgggtaagattactggaaaggagggtctgcggtttgagggtatagctaaatgctatgattacgaagatgcattcattgagtcccttgagcggggtgagatcaagaagggcgagaaaacagtcgtgattatccggtatgaaggccccaagggtggcccaggaatgcctgagatgctcaagcccagcgcggccattatgggcgctggacttggccaggacgttgctcttcttacagatggaagattctcgggtggcagtcacggatttttgatcggacatatcgtgccggaagccatggaaggcggcccgatcgcgttggctcgagacggtgatcggatcgtgattgatgctgaggaaagagtggtcgatctggatatctctactgaggagctcgagaagaggaggaaggagtggaacgcacccccgctccggtaccagaagggaactctgaagaaatattgcacgctggtcagcgacgccagccatggttgtgtcacggacggaccgatatag

SEQ ID NO: 424 - protein, 598 aa, Aspergillus niger
MFASSIRSRALGLSPRARFENTRLPSSTSGRRYRSDEPLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLIAMGRTNRPSIMVYGGSIKPGCSAKGQKLDLVSAFQSYGQFITGQIDEKERFDIIRNACPGRGACGGMYTANTLATAIETMGMTIPGSSSCPADDRKKLVECENIGEVVKNMLREDIKPRDILTRQAFENAMIVVNVLGGSTNAVLHLIAIADSVGIKLTIDDFQAVSDKTPFLADLKPSGKYLMNDLYNIGGTPALLKYLLKEGLIDGSGVTVTGKTMKENVASWPDFPADQDIIRPLNNPIKPSGHLQILRGSLAPGGSVGKITGKEGLRFEGIAKCYDYEDAFIESLERGEIKKGEKTVVIIRYEGPKGGPGMPEMLKPSAAIMGAGLGQDVALLTDGRFSGGSHGFLIGHIVPEAMEGGPIALARDGDRIVIDAEERVVDLDISTEELEKRRKEWNAPPLRYQKGTLKKYCTLVSDASHGCVTDGPI

SEQ ID NO: 425 - DNA, 1875 bp, Neosartorya fischeri
atgttcgcgtcgagtatccgatcgagagctctgggattgagcccacgagcccggtttgagaatacgtacgagaggaccttccctcgcattgcttctctctccctcctcaaaaatcggcaaatactaataactatcgttactagtcgtcttccatcttccactaccgagcgccgttataaatccgacgagaccctcaaccgaatctcctcgaaaatcacacaacccaaatcccagggtgcctcacaagcaatgctctacgccaccggcctgacagaggaagacatgtccaagccgcaggtcggtatctcctcggtgtggttcgagggtaacccatgtaacatgcacttgcatgacctgtctgcgattgtgcgtgattccgtgcttcgggcgggtctggttcctatgcgattcaactcggttggagtgtcggatgggatcagtatgggcacaaagggaatgagatacagcctacagagtcgggagctgatcgctgatggcattgagacagtgatgaatgcccagtggtatgatgcgaatgtgtcgctcccaggttgcgataagaatatgccaggtgtgttaatggcaatgggacgcacgaatcggcctagtatcatggtctatggcggcagtatcaaacccggatgcagtgcaaagggccaaaagttagacctggtcagtgcattccagtcatatggacagttcatcaccggccagatcgatgagaaggaacggtttgatataattcgcaatgcatgccccggcagaggtgcctgcggtggcatgtacacagctaatacgctggccacagccattgagactatgggtatgaccgttcccggtagcagtagttgcccggcagacgatcctaagaagcttgttgagtgcgaaaacatcggggaggtggttaagactatgctcagggaagatatcaagcccagggatgtcttgacacgtcaagcttttgagaatgcaatgattgtggtgaacgtgctgggtggcagcactaatgctgttctacatctgattgctattgctgactctgttggtatcaagttgactattgatgacttccagacagtgtctgacaagacaccattcctagctgatttgaagccatctggaaaataccttatgaatgacctatacaacatcggtggcacaccagccctccttaaatatctcctaaaggagggcttgatcgatggctcaggaattactgtcactggcaaaacaatgaaggagaatgtagcctcatggcctgacttccctgctaaccaggatatcattcgccccctcagcaaccctattaaaccatctggtcatctccagattcttcgcggatcgctggccccgggcggttctgttgggaagattactggaaaggagggtctgcggtttgagggcacagctaagtgctatgactacgaagatgcattcattgagtcccttgagcggggcgagatcaagaagggcgacaaaacagtcgtgattattcggtatgaaggtcccaagggtggcccaggaatgcctgagatgctcaagcccagcgcggccattatgggtgctggtcttggccaggacgttgcacttctcacggacgggagattctcaggtggcagtcacggattcttgatcggacatattgtgccggaagccatggagggtggcccgatcgcgttagcacgagacggtgatcggatcgtgattgatgctgaggaaagagtggttgatctggatatcccgattgaagagctcgagaagaggaggaaggagtggaaagcacccccgctccgataccagaagggaactttgaagaagtattgcacgctggtcagcgatgccagccatggttgtgtcacagacggcccgatctag

SEQ ID NO: 426 - protein, 624 aa, Neosartorya fischeri
MFASSIRSRALGLSPRARFENTYERTFPRIASLSLLKNRQILITIVTSRLPSSTTERRYKSDETLNRISSKITQPKSQGASQAMLYATGLTEEDMSKPQVGISSVWFEGNPCNMHLHDLSAIVRDSVLRAGLVPMRFNSVGVSDGISMGTKGMRYSLQSRELIADGIETVMNAQWYDANVSLPGCDKNMPGVLMAMGRTNRPSIMVYGGSIKPGCSAKGQKLDLVSAFQSYGQFITGQIDEKERFDIIRNACPGRGACGGMYTANTLATAIETMGMTVPGSSSCPADDPKKLVECENIGEVVKTMLREDIKPRDVLTRQAFENAMIVVNVLGGSTNAVLHLIAIADSVGIKLTIDDFQTVSDKTPFLADLKPSGKYLMNDLYNIGGTPALLKYLLKEGLIDGSGITVTGKTMKENVASWPDFPANQDIIRPLSNPIKPSGHLQILRGSLAPGGSVGKITGKEGLRFEGTAKCYDYEDAFIESLERGEIKKGDKTVVIIRYEGPKGGPGMPEMLKPSAAIMGAGLGQDVALLTDGRFSGGSHGFLIGHIVPEAMEGGPIALARDGDRIVIDAEERVVDLDIPIEELEKRRKEWKAPPLRYQKGTLKKYCTLVSDASHGCVTDGPI

SEQ ID NO: 427 - DNA, 1626 bp, Neosartorya fischeri
atgctgtatgcgactggtttggaggaagcggatatgaacaaggcccaggtgggaatctcctcggtgtggtttgagggaaacccttgcaacatgcacctgatggacttgtccttggtggtacgcgactcggtcgccagggccggcctggttccaatgcgttttaactcgattggcgtttccgacggaatcagcatgggcacgagcggtatgcgatacagtctgcagagtcgtgagatcatcgcggacggcattgagacggtcatgaacgggcagtggtatgacgcgaatatctcacttccaggatgcgataagaacatgcccggtgttgttatggccatgggccgggtcaaccgtccgagcattgtgatctatggtggtagtattaagcctggttgcagcgctggtggccagactttggatctggtgagcgcctttcagtcatatggccaatacattactggtcagatagatgaagcacagcgctttgacatcattcgccatgcgtgcccgggaagtggtgcgtgtggtggcatgtatacagcgaataccatggccacagctattgaagttctcgggctcacggttccaggcagtagtagctgccccgcagaagatccgcgcaagaaagctgaatgtgaagagattggagaaacagtcaagaacctcttgaaggaagatatccggccttcggatattttgacccgccaagcatttgagaacgcaatgatcgtggtcaatattttgggaggtagcaccaatgcagtcatgcatttgattgccattgcccaatctgtgggaattaagctcaccattgatgatttccaagctgtgtctgacaagacgccatttctggccgacctaaaaccatcaggaaagtatgtcatgcatgacctgtacaagatcggcggcacaccggccctactccggttcctgctcaaggagggcttgattgacgggtctggtattactgtgaccggcaaaacaatgaaggagaatgttgcatcttggcctgatttccctgaagatcagcccattatccggccactgagcgatcccatcaagcccacgggtcaccttcaaattctgcgaggatccttggcacctggaggctccgttggtaagatcaccggtaaagagggtctccgatttgaaggcagtgccaagtgctacgactatgaagatgcctttgtggatgctcttgaaaagggagaaattaagaagggtgaaaagacagttgttattatccgatacgaggggccaaagggtggtccaggtatgccggaaatgctcaagcctagtgccgccatcatgggtgccggactgggtcaggatgtcgccctccttaccgacggtcgattttctggtggcagtcatggattcctaatcggtcatattgttcctgaggcaatggatggtggtccaatcgccctggtcaaagatggggacagggtgattatcgacgcagagaagagggtggttgatctggatatatccggagaagagatgcagaggaggaagaaggcatggaaagcgcctgaacctcgggcaaagaaaggcactctaaagaagtatgcagctcttgtcagtgacgctagccatggctgtgtcactgatgggccactttga

SEQ ID NO: 428 - protein, 541 aa, Neosartorya fischeri
MLYATGLEEADMNKAQVGISSVWFEGNPCNMHLMDLSLVVRDSVARAGLVPMRFNSIGVSDGISMGTSGMRYSLQSREIIADGIETVMNGQWYDANISLPGCDKNMPGVVMAMGRVNRPSIVIYGGSIKPGCSAGGQTLDLVSAFQSYGQYITGQIDEAQRFDIIRHACPGSGACGGMYTANTMATAIEVLGLTVPGSSSCPAEDPRKKAECEEIGETVKNLLKEDIRPSDILTRQAFENAMIVVNILGGSTNAVMHLIAIAQSVGIKLTIDDFQAVSDKTPFLADLKPSGKYVMHDLYKIGGTPALLRFLLKEGLIDGSGITVTGKTMKENVASWPDFPEDQPIIRPLSDPIKPTGHLQILRGSLAPGGSVGKITGKEGLRFEGSAKCYDYEDAFVDALEKGEIKKGEKTVVIIRYEGPKGGPGMPEMLKPSAAIMGAGLGQDVALLTDGRFSGGSHGFLIGHIVPEAMDGGPIALVKDGDRVIIDAEKRVVDLDISGEEMQRRKKAWKAPEPRAKKGTLKKYAALVSDASHGCVTDGPL

SEQ ID NO: 429 - DNA, 1845 bp, Aspergillus niger
atgccttttctgcggtggcctccaggccagaaaatcatgatcacacctaccactcctttccgagctgccagaactctggcattcggtggacggatactatcgcccaaaaagtcatcctctcgtcttctctcctcaactgcacatagttatgccgacgaaacactgaacaaagtctcctctaagatcacacaacccaagtcccagggtgcatctcaagcgatgctttacgcgaccggcttgacggagaaagacatgtccaaggcacaggttggaatttcatcagtgtggttcgaagggaatccttgtaacatgcacttgatggatttgtcgtcgctggttcgcgagtcggtagccaaagctggcctggttcccatgcgtttcaactccatcggcgcctctgatggcattagtatgggcacatctggcatgcgattcagtttacagagccgagagatcattgctgatggaattgaaacggtcatgaatgcccagtggtatgatgctaatatctcgttgcctggctgtgataagaacatgccaggtgtgctgatggctatgggtcgggtcaaccgtccgagtatcatggtgtatggtggtagtatcaagcccggctgcagtgcggggggtaagccacttgacttggtcagcgcctttcaatcgtatggccaatatctcactggtgagatcgacgagaaggaacgatttgatattatccgacacgcttgcccaggtgctggtgcctgtgggggtatgtatacggctaatacactggcaacggccatcgagaccctcggaatgacggtccctggaagcagcagtacaccggcagaggatccgaggaagctggcagagtgtgaggacatcggtcagacggtgaagaatctgctgaaggaggacatccgtcccaaggatatcatgacacggcaggcatttgaaaatgctatgattgttgtgaatattcttggaggcagcaccaatgcagtgctgcacttgattgctatcgctaattccgttgggatcaaattgactatcgatgacttccaggctgtgtcagacaagacacctttcttagctgatctaaagccttccggcaagtatgtcatgcatgacctgtacaaagtcgggggcacgcctgcactgctgaagttcctgctcagggaaggccttattgacggctccggcgtcactgttactggcaaaaccatgaaagagaatgtagcctcatggcccgaattttcacctgagcagcccatcatccgccctctaagcaatcccatcaagccaaccggccacttgcagatccttcgtgggtcattggcccccggcggctcggttggaaaaatcaccggcaaagaaggtctacggttcgaaggtcttgctaaatgttacgactttgaggacgctttcattgaggctctcgaacgaggcgagatcaagaagggcgagaaaacggtcgttattattcgatatgaagggcccaaaggcggccccgggatgcctgagatgctcaagcccagctcagctatcatgggcgcgggattgggtcaggatgttgcgctactcactgatggaagattctctggaggtagtcatggctttttaattgggcatgttgtgcctgaggctatggagggtgggcccattgccctggtgaaggatggcgatcggatcgtaattgatgcggagcaaagagtggttgacctgctgatcaccccagaagaaatggcaaagagaagagtgtcttggacagcaccggcacctcgggcgaagaaggggacattaagcaagtatgcgaagctggtgagcgatgcgagccatgggtgcgtgacggatggtccaatatag

SEQ ID NO: 430 - protein, 613 aa, Aspergillus niger
MPFLRWPPGQKIMITPTTPFRAARTLAFGGRILSPKKSSSRLLSSTAHSYADETLNKVSSKITQPKSQGASQAMLYATGLTEKDMSKAQVGISSVWFEGNPCNMHLMDLSSLVRESVAKAGLVPMRFNSIGASDGISMGTSGMRFSLQSREIIADGIETVMNAQWYDANISLPGCDKNMPGVLMAMGRVNRPSIMVYGGSIKPGCSAGGKPLDLVSAFQSYGQYLTGEIDEKERFDIIRHACPGAGACGGMYTANTLATAIETLGMTVPGSSSTPAEDPRKLAECEDIGQTVKNLLKEDIRPKDIMTRQAFENAMIVVNILGGSTNAVLHLIAIANSVGIKLTIDDFQAVSDKTPFLADLKPSGKYVMHDLYKVGGTPALLKFLLREGLIDGSGVTVTGKTMKENVASWPEFSPEQPIIRPLSNPIKPTGHLQILRGSLAPGGSVGKITGKEGLRFEGLAKCYDFEDAFIEALERGEIKKGEKTVVIIRYEGPKGGPGMPEMLKPSSAIMGAGLGQDVALLTDGRFSGGSHGFLIGHVVPEAMEGGPIALVKDGDRIVIDAEQRVVDLLITPEEMAKRRVSWTAPAPRAKKGTLSKYAKLVSDASHGCVTDGP

SEQ ID NO: 431 - DNA, 1848 bp, Aspergillus niger
atgcttctttcccaaacccgggggcgtatgccctccgctctccggagcatcgccaagcgctctttgctgaacagtcgccctctgtctaccactctgcccaagcaacagaacggcaacgatgacgagtatactggtctcaacaaggtctcccgccacattacccagcccatctcccagggtgcttcccaggccatgctgtatgccgcaggcctcactgaggcggacatgaacaaggctcaggtcggcatttcttctgtctggtacaatggcaacccctgcaacatgcatctgctcgatcttaacaaccgtgtccgcgagggtgtccagaaggccggtttggtcggtttccagttcaacaccgtcggtgttagcgatgctatcagtatgggtaccaagggaatgcgattctctctccagagtcgtgatctgattgccgactctatcgagaccgttatgggtggtcaatggtatgacgctaacatcagcattcccggctgtgacaagaacatgcctggtgtgttgatggcaatgggacgagtgaaccgccccagtttgatggtctacggtggaaccatcaagcctggttgcgcctccatgcagggcaacgccgacattgatatcgtctccgccttccaggcctatggtcagttcatcagtaaggaaatcaccgagccccagagatttgacattatccgcaacgcctgccctggaggtggtgcttgcggtggtatgtacactgccaataccatggccactgctatcgaagtcatgggcatgacccttcctggatcctcttccaaccccgccgagtctgacgctaagtaccttgaatgtcttgcggctggtgaggccatcaagaccctgctcaaggaggacattcgtccttcggacatcctgactcgccaagctttcgagaacgccatggtcttggtcaacatcactggtggctccaccaacgccgttcttcacttgattgccattgcggactctgttggtatcaagctcgacattgaagacttccagtccgtctcggatcgcattcctttcctggcggaccttaagccttccggcaagtacgtcatggctgaccttcacaagatcggtggtaccccctccctgctcaagttcttgctgaaggaaggtctcatcgatggctctggcatgactgtcactggtcagaccctggccaagaacttggagaatgtgccggacttccctgaggatcagaagatcatccgtcccctgtccaaccccatcaaggagactggccacatccagatcttgaggggttctctggccccgggtggcagtgtcggcaagatcactggtaaggaaggaaccgtcttcactggaaaggctcgcgtctttgacgacgaggatgatttcattgctgctctcgagcgcaacgagatcaagaaggaggagaagactgttgttgtcatccgctacactggtcctaagggaggacctggcatgcccgaaatgctgaagccctcttccgccctgatgggtgccggtctcggacagtcctgcgctctgatcaccgatggccgtttctctggtggttctcacggtttcttgatcggacacattgttcccgaagccgccgtcggtggccccattggcttggttaaggatggtgatgtcatcaccattgacgccgagaagcgtgttctggaccttgatgttgaggagaccgagctcgcgcaaagaagaaagcagtgggaagccgacagggctgctggcaagctccctcccaccggcctgaccctgagaggtactctcggcaagtacgctagaaccgtcaaggatgccagccacggctgtatcaccgactctctcgaataa

SEQ ID NO: 432 - protein, 615 aa, Aspergillus niger
MLLSQTRGRMPSALRSIAKRSLLNSRPLSTTLPKQQNGNDDEYTGLNKVSRHITQPISQGASQAMLYAAGLTEADMNKAQVGISSVWYNGNPCNMHLLDLNNRVREGVQKAGLVGFQFNTVGVSDAISMGTKGMRFSLQSRDLIADSIETVMGGQWYDANISIPGCDKNMPGVLMAMGRVNRPSLMVYGGTIKPGCASMQGNADIDIVSAFQAYGQFISKEITEPQRFDIIRNACPGGGACGGMYTANTMATAIEVMGMTLPGSSSNPAESDAKYLECLAAGEAIKTLLKEDIRPSDILTRQAFENAMVLVNITGGSTNAVLHLIAIADSVGIKLDIEDFQSVSDRIPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDDEDDFIAALERNEIKKEEKTVVVIRYTGPKGGPGMPEMLKPSSALMGAGLGQSCALITDGRFSGGSHGFLIGHIVPEAAVGGPIGLVKDGDVITIDAEKRVLDLDVEETELAQRRKQWEADRAAGKLPPTGLTLRGTLGKYARTVKDASHGCITDSLE

SEQ ID NO: 433 - DNA, 1833 bp, Aspergillus terreus
atgcttctctctcagacccggggccgtctgccctccctgcggaccctcaagcggtccatggcggtccgtccgctctctaccaccctccccaagcacaaggccgatgagaaagagcctgtcctcaacaaagtctcccgccatgtcacccaacccatctcccagggtgcgtcccaggccatgctctacgccaccggtctcaccgaggccgacatgaacaaggcccaggtcggtatctcctccgtctggtacaatggcaacccctgcaacatgcacctcctcgacctcaacaaccgtgtgcgggagggtgtccagaaggctggcctggtcgggttccagttcaacaccgtcggagtcagcgacgcgatcagcatgggtacctccggtatgcgcttctcgctgcagagccgtgatctcattgccgactccattgagactgtcatgggtggtcagtggtacgacgccaacatcagtatccctggttgcgacaagaacatgcccggtgtcctgatggccatgggcagagtcaaccgtcccagtctgatggtttacggtggttccattaagcccggctgcgcttcgatgcagaacaacgccgatatcgatatcgtctccgccttccaggcgtacggtcagttcatcagcggagagatcaccgagccccagcgtttcgacatcatccgcaacgcctgccccggaggtggcgcgtgcggtggtatgtacaccgccaacaccatggccaccgccatcgaggtcatgggtatgacccttcctggttcctcctccaaccccgccgagtcggcggccaagaacatcgagtgtctggcggccggtgaggccatcaagaagcttctggtggaagacatccgtccctccgatatcctgactcgccaggccttcgagaatgccatgattgttgtgaacattaccggtggttcgaccaatgcggtgctgcaccttatcgccattgccgattcggtcggcatcaagctagatattgaggacttccagaaggtctcggaccgtgtgccgttcctggctgacctcaagccttccggcaagtacgtcatggcggacctgcacaagatcggtggtactccttctctgctcaagttcctgcttaaggagggcctgatcgatggctctggtatgaccgtcaccggtcagaccctggccaagaacctggagaacgtgccggacttccccgaggaccagaagatcatccgtcctctgtctaaccccatcaaggagaccggtcacatccagattctccgtggctctctggcccctggcggtagtgtcggtaagatcactggtaaggagggtaccgttttcaccggtaaggctcgcgtcttcgaccacgaggacgacttcatcgctgcgctcgagcgcaaggagatcaagaaggaggagaagacggtcgttgtcatccgttatactggacccaagggtggtccgggtatgcctgaaatgctgaagccttcttctgccctcatgggcgccggtctgggcggctcctgcgctctgatcaccgacggacgtttctccggcggctctcacggattcctgatcggacatatcgtccccgaggctgctgtcggtggaccgattggtctggttaaggacggcgatgtgatcaccatcgacgccgtcaagcgtgtgctggatctggacgttgacgagaccactctggccgagagaagaaagcagtgggaggccgacaaggaggctggccgtctccctcctaccggtctgactctgcgtggtaccctgggcaagtatgctagaaatgtcaaggatgccagccacggctgcatcaccgatgctcttgactaa

SEQ ID NO: 434 - protein, 610 aa, Aspergillus terreus
MLLSQTRGRLPSLRTLKRSMAVRPLSTTLPKHKADEKEPVLNKVSRHVTQPISQGASQAMLYATGLTEADMNKAQVGISSVWYNGNPCNMHLLDLNNRVREGVQKAGLVGFQFNTVGVSDAISMGTSGMRFSLQSRDLIADSIETVMGGQWYDANISIPGCDKNMPGVLMAMGRVNRPSLMVYGGSIKPGCASMQNNADIDIVSAFQAYGQFISGEITEPQRFDIIRNACPGGGACGGMYTANTMATAIEVMGMTLPGSSSNPAESAAKNIECLAAGEAIKKLLVEDIRPSDILTRQAFENAMIVVNITGGSTNAVLHLIAIADSVGIKLDIEDFQKVSDRVPFLADLKPSGKYVMADLHKIGGTPSLLKFLLKEGLIDGSGMTVTGQTLAKNLENVPDFPEDQKIIRPLSNPIKETGHIQILRGSLAPGGSVGKITGKEGTVFTGKARVFDHEDDFIAALERKEIKKEEKTVVVIRYTGPKGGPGMPEMLKPSSALMGAGLGGSCALITDGRFSGGSHGFLIGHIVPEAAVGGPIGLVKDGDVITIDAVKRVLDLDVDETTLAERRKQWEADKEAGRLPPTGLTLRGTLGKYARNVKDASHGCITDALD

SEQ ID NO: 435 - DNA, 1824 bp, Aspergillus clavatus
atgcttctctctcagacccggggccgtgtgccctctgttctccggagcttctcccgccgctccctctctaccaccatccccagatacaccgccgataaggatgactctgctctcaacaaggtgtcccgcaatgtcacacagcccatctcgcagggtgcctcccaggccatgctgtacgccacgggtcttaccgaggcggacatgaacaaggctcaggtcggtatctcgtcggtctggtacaatggcaacccctgcaacatgcatctgctcgatctcagcaaccgcgttcgcgaaggagtccagaaggctggtctggttggcttccagttcaacacggtcggtgtcagtgatgccatcagcatgggcaccaagggcatgcgcttctccctgcagagccgtgacctgattgccgactccatcgagaccgtcatgggtggtcagtggtacgacgccaacatcagtatccccggttgcgacaagaacatgcccggtgtgctcatggccatgggccgtgtcaaccgccccagtttgatggtgtatggtggtaccatcaagcccggctgcgccaaaacccagaacaacgccgacatcgacattgtctcggccttccaggcgtacggacagttcctgactggcgagatcaccgagccccagcgcttcgacatcatccgtaacgcctgccccggcggtggtgcttgcggtggtatgtacactgccaacaccatggccaccgccatcgaggtcatgggtatgaccctgcctggctcgtcgtccaaccccgctgagtctaaggccaaggaccttgagtgcttggctgctggtgaggccatcaagcgcctgctgaaggaggatatccgtccctcagacatcctgacccgccaggccttcgagaacgccatgattgtggtcaacatcaccggtggctccaccaacgccgtacttcacttgatcgccattgccgactccgtcggcatcaagctggacatcgaggagttccagaaggtctcggaccgcacccccttcctggcggacctcaagccctccggcaagtacgtcatggccgatctgtacgacatcggcggaactcctgctctgctcaagttcctgctcaaggagggcgtcatcgacggctccggcatgaccgtcaccggtgagaccctggccaagaacttggagaaggtgcccggcttccccgaggaccagaagatcatccgtcctttttcgaaccccatcaagaagactggccacattcagatcctgcgcggctccctggcccccggcggcagtgttggcaagatcaccggtaaggagggtacccgcttcgttggcaaggcccgcgtcttcgaccacgaggacgacttcattgccgctctcgagcgcaacgaaatcaagaaggaggacaagaccgttgtcgtcatccgctacaccggccctaagggtgggcccggcatgcctgaaatgctcaagccctcctccgccctgatgggcgccggcctcggctcctcctgcgcactcatcaccgacggtcgtttctccggcggctcccacggcttcctgattggccacatcgtccccgaggccgccgtcggcggccccatcggcctcgtccaggacggcgacatcatcaccatcgacgccgagaagcgcatcctcgacctcgacgtccccgagcccgagctcgcccagcgcagaaaggattgggaggccgccaaggccgccggcaagttgccccagaccggtctcaccatgagaggtaccctgggcaaatatgccagaaccgtcaaggatgccagccacggctgcattactgattatatagaataa

SEQ ID NO: 436 - protein, 607 aa, Aspergillus clavatus
MLLSQTRGRVPSVLRSFSRRSLSTTIPRYTADKDDSALNKVSRNVTQPISQGASQAMLYATGLTEADMNKAQVGISSVWYNGNPCNMHLLDLSNRVREGVQKAGLVGFQFNTVGVSDAISMGTKGMRFSLQSRDLIADSIETVMGGQWYDANISIPGCDKNMPGVLMAMGRVNRPSLMVYGGTIKPGCAKTQNNADIDIVSAFQAYGQFLTGEITEPQRFDIIRNACPGGGACGGMYTANTMATAIEVMGMTLPGSSSNPAESKAKDLECLAAGEAIKRLLKEDIRPSDILTRQAFENAMIVVNITGGSTNAVLHLIAIADSVGIKLDIEEFQKVSDRTPFLADLKPSGKYVMADLYDIGGTPALLKFLLKEGVIDGSGMTVTGETLAKNLEKVPGFPEDQKIIRPFSNPIKKTGHIQILRGSLAPGGSVGKITGKEGTRFVGKARVFDHEDDFIAALERNEIKKEDKTVVVIRYTGPKGGPGMPEMLKPSSALMGAGLGSSCALITDGRFSGGSHGFLIGHIVPEAAVGGPIGLVQDGDIITIDAEKRILDLDVPEPELAQRRKDWEAAKAAGKLPQTGLTMRGTLGKYARTVKDASHGCITDYIE

SEQ ID NO: 437 - DNA, 1842 bp, Aspergillus nidulans
atgcttctttcacagactcggggccgcctgccctctgctctccgcagcttggccaacagagctgctattcgtccaatctctactacactcccccgccaaaaagcgtcgccaaaagatgatgagcccgtcctcaacaaggtctcccgccatatcacacagccggtgtcccagggtgcttcccaggcgatgctgtacgctacgggtcttactgaggccgacatgaacaaggcccaggttggtatttcctcggtctggtacaacggcaacccttgcaacatgcacctcctcgacctgaacaaccgtgtccgcgagggtgtgcaaaaggctggccttatcgggtaccagttcaacaccattggtgtcagtgatggaatcagtatgggtaccagtggtatgcgttactcgcttcagagccgtgacctcatcgccgactctatcgagaccgtcatgggtggtcagtggtacgacgccaacatcagcatccccggttgcgacaagaacatgcccggtgttttgatggctatgggacgagtcaaccgccccagtttgatggtttacggtggaaccatcaagcccggctgcgcatccatgcagggcaacgctgacatcgatatcgtctctgccttccaagcctacggccagttcatcagcggtgagatcaacgagccccagcgcttcgatatcatccgccacgcctgccccggtggcggcgcttgcggtggaatgtacactgccaacaccatggccacggccatcgaagtcatgggtatgaccctcacgggctcctcgtccaacccggccgaatcgcaagccaaatacgacgaatgtcttcgcgctggtgaagccatcaagcgcctcctcgtcgaagacatccgcccctccgacatcatgactcggcaagccttcgagaacgccatggtcgttgtcaacatcaccggcggctccaccaatgctgtccttcacctcatcgccattgccgactccgtcggcatcaagctcacaattgacgacttccaagccgtctctgaccgcacccccttcctcgcagacctcaagccatccggcaaatacgttatggccgacctccacaacatcggcggcaccccctccctcctcaaattcctcctcaaggaaggcgtcattgatggctccggcatcacagttaccggtgaaactctcgccaagaacctcgagaaagtccccgatttccccgaggaccagaaaatcattcgccccttctccaaccccatcaaggaaacaggccacatccagatcctgcgcggttcgctcgcgccgggcggttgcgttggtaagattaccggtaaggagggaaccgttttcacgggcaaggcccgcgtctttaaccacgaagacgacttcattgccgccctggagcgcaaggaaatcaccaaggatgagcaaactgtcgttgtgattcgctacaccggtcccaagggtggtcccggtatgcctgaaatgctcaagccttcaagcgccctcatgggtgctggcctcggccaaacctgcgccctgatcacagacggacgcttctccggtggttcgcacggcttccttattggacacatcgtcccagaggctgccgtcggtgggccgattggtctcgtacacgacggcgacgtgatcaccattgatgccgagaagcgcgttttggaccttgacgttgacgaggcggaactcgctaagcgacggaagcagtgggaggctgataaggcggcgggcaagttgccccagaccgggttgaacttgcgcgggacgcttggaaagtatgcccggaatgtcaaggatgctagttccgggtgtattacggacgctttcgattaa

SEQ ID NO: 438 - protein, 613 aa, Aspergillus nidulans
MLLSQTRGRLPSALRSLANRAAIRPISTTLPRQKASPKDDEPVLNKVSRHITQPVSQGASQAMLYATGLTEADMNKAQVGISSVWYNGNPCNMHLLDLNNRVREGVQKAGLIGYQFNTIGVSDGISMGTSGMRYSLQSRDLIADSIETVMGGQWYDANISIPGCDKNMPGVLMAMGRVNRPSLMVYGGTIKPGCASMQGNADIDIVSAFQAYGQFISGEINEPQRFDIIRHACPGGGACGGMYTANTMATAIEVMGMTLTGSSSNPAESQAKYDECLRAGEAIKRLLVEDIRPSDIMTRQAFENAMVVVNITGGSTNAVLHLIAIADSVGIKLTIDDFQAVSDRTPFLADLKPSGKYVMADLHNIGGTPSLLKFLLKEGVIDGSGITVTGETLAKNLEKVPDFPEDQKIIRPFSNPIKETGHIQILRGSLAPGGCVGKITGKEGTVFTGKARVFNHEDDFIAALERKEITKDEQTVVVIRYTGPKGGPGMPEMLKPSSALMGAGLGQTCALITDGRFSGGSHGFLIGHIVPEAAVGGPIGLVHDGDVITIDAEKRVLDLDVDEAELAKRRKQWEADKAAGKLPQTGLNLRGTLGKYARNVKDASSGCITDAFD

SEQ ID NO: 439 - DNA, 1848 bp, Aspergillus oryzae
atgcttctttcacaaacccgggggcgtatgccctctgctctgcggagcctctccaggcggtccgccgtcaatgttcgtcccctctctaccaccctccccaagcaaaaggcctcttcctccgaagacgacaacgctctgaacaaggtctcccgccatgtcacacagcccatctcgcagggtgcttcccaggccatgctttacgctaccggtctcaccgaggaggacatgaacaaagctcaagtcggtatctcctccgtttggtatagcggtaacccctgtaacatgcatctgctcgatctcaaccaccgcgtcaagcaaggtgtggaacaggcaggcttgatcggcatgcagttcaacaccgtcggtgtcagtgatgcaatcagtatgggtacgaagggtatgcgatattctcttcagagtcgtgatctgattgccgactctatcgagactgttatgggtggtcagtggtacgatgccaacatcagtatcccgggttgcgacaaaaacatgcccggtgtgttgatggccatgggcagagtcaaccggccgagcattatgttgtacggaggcaccatcaagcccggttgtgccgctacccaaaacaatgccgagattgacatcgtctccgcattccaggcctacgggcagttcctgagcggcgacattaccgagcctcagcgatttgatattatccgtaacgcttgcccaggaggcggtgcctgcggtggtatgtacacggccaacaccatggccaccgccattgagaccattggtatgaccctccctggctcttcttccaaccccgccgagtcccgcgccaaggaccttgagtgtctggctgttggtggggcgatcaagaagcttctgaaggaggacatccgccctagggatattatgacccgccaagctttcgaaaacgccatggttgtggtgaacatcaccggtggctcgaccaacgctgtgctgcacttgattgccatcgctgattcggtcggcatcaagctggatattgaggacttccagtccgtctccgaccgtattcctttcttggctgatctgaagccatcgggcaagtacgtcatggccgacatgcacaagatcggaggtacccccgcactgctcaagttcctgctcaaggaaggcctcatcgatggttccggcatgactgtcaccggtgagactctagccaagaacctcgagaaggttcccgatttccccgaagatcagaagatcatccgccctctgtccaaccccatcaaggagactggccatatccagattctgaagggatccctggctccgggtggcagtgttggtaagatcactggcaaggagggtacttctttcactggtaaggcacgtgtcttcgatgatgaggatgatttcatcgctgctctggagcgtggtgagatcaaaaaggaggacaagactgttgtggttatccgctacaccgggcccaaggggggtcctggtatgcccgaaatgttgaagccctcttctgcccttatgggctatggtctcggacagtcggttgccctcatcaccgatggacgtttctccggcggctctcatggcttcctgatcggacacattgtccctgaggctgctgttggtggacctattggtctcgtcaaggatggtgatgtcatcgtcattgatgctgagaagcgcgttctcgaccttgaggttgaccaggagactctcgccgagagacgcaagcagtgggaagccgataaggaggccggcaagctgcctcccaccggtctgactatgagaggaaccctcggcaagtacgctaggaccgtcaaggatgccagccacggctgtatcaccgatgctcttgattaa

SEQ ID NO: 440 - protein, 615 aa, Aspergillus oryzae
MLLSQTRGRMPSALRSLSRRSAVNVRPLSTTLPKQKASSSEDDNALNKVSRHVTQPISQGASQAMLYATGLTEEDMNKAQVGISSVWYSGNPCNMHLLDLNHRVKQGVEQAGLIGMQFNTVGVSDAISMGTKGMRYSLQSRDLIADSIETVMGGQWYDANISIPGCDKNMPGVLMAMGRVNRPSIMLYGGTIKPGCAATQNNAEIDIVSAFQAYGQFLSGDITEPQRFDIIRNACPGGGACGGMYTANTMATAIETIGMTLPGSSSNPAESRAKDLECLAVGGAIKKLLKEDIRPRDIMTRQAFENAMVVVNITGGSTNAVLHLIAIADSVGIKLDIEDFQSVSDRIPFLADLKPSGKYVMADMHKIGGTPALLKFLLKEGLIDGSGMTVTGETLAKNLEKVPDFPEDQKIIRPLSNPIKETGHIQILKGSLAPGGSVGKITGKEGTSFTGKARVFDDEDDFIAALERGEIKKEDKTVVVIRYTGPKGGPGMPEMLKPSSALMGYGLGQSVALITDGRFSGGSHGFLIGHIVPEAAVGGPIGLVKDGDVIVIDAEKRVLDLEVDQETLAERRKQWEADKEAGKLPPTGLTMRGTLGKYARTVKDASHGCITDALD

SEQ ID NO: 441 - DNA, 1836 bp, Ajellomyces capsulatus
atgctccgattacaagcacggggccggatgcccaactgcttcaaaagactgcttttcccattgtcctgtcgagctctctccgcaactccatacccatattcatcttcgtcctcacaggagaagaagctcaacagtgtttcccaacatgtaacgcaacccatttcccaaggtgcctcacaggccatgctttacgctacgggcctaatgccggaggatatgtcgaaagctcaagttggcatctctagcgtctggtacaacggaaacccctgcaacatgcatctcctcgatctcagcaaccgtgtgcgcgaaggtgtgcaaaaggcgggactcataggttaccagttcaacactgttggcgtcagtgacgctatcagcatgggtacgtcaggtatgcggtacagtttgcagagtcgggatctcatcgcggactcgattgagacggtcatgggtggtcaatggtatgatgctaacatcagcatccccgggtgtgacaagaatatgcctggcgtggttatggcaatgggaagagtaaaccggccaagtttgatggtttatggcggaacaattaagcccgggtgcgcggtaacccaaaacaacgccgatatcgacatcgtgtctgcgttccaggcttacggccaattcataactggtgagatcactgaggctcagcgatacgacatcatccgacatgcttgccctggcggtggtgcttgtggggggatgtacactgcaaacaccatggcgtctgcgatcgaagttatgggaatgacgttaccgggatcttcatcgaaccctgcagaatccaaagccaaggatctagaatgcctgacggctggggaagcaattaaaacccttctcaaggaggatatccgtcccactgacatcttgacgcgccaggcctttgaaaatgcaatggttcttgtcaacatcaccggcggctccaccaacgcagtgctccatctgatcgctatagctgactctgtcggaattaaactcacaattgacgatttccagtcagtcagtgaccgcatccccttcctcgcagatctcaagccttccggtaaatatgttatggccgatcttcatacaattggtggtactccctcattactcaagttcctcttgaaggagggtctcatcgacggctctggaattaccgtgactggtcaaaccctggccaagaacctcgagaaggttcctgaattcccttcagatcagaaaatcattcgacccctcaacaaccccatcaagaaaactgggcacatccagatcctccgcggaagcctcgcccctgaaggcagcgtcggcaaaattacaggaaaggagggtaccaagttcactggcaaggcgaaggtctacgatcatgaagacgattttattaccgcattagaacagaatgagatttcgaaggacgagaagacagtcgtggtaattcgttacactgggcccaagggtggtccgggaatgcctgaaatgctcaagccttcctccgcccttatgggcgcggggctaggttcatccgtcgccttgatcacagacggccgtttcagtggtggctctcatggcttcctgatcggccacatcgttcccgaagccgcagtcgggggccctattgcgctcgtccacgatggcgatgtcatcaccattgacgccgaaaaacgtttgctcgaccttgacgtctccgaacacatcctagctcagcgtaggaaggaatgggccgatagggagagtaaaggactaaatcccgttacgggaatgaaaatgagagggacgctgggaaaatatgctagatctgtcaaggacgcaagtcacggatgcatcaccgacgcattatag

SEQ ID NO: 442 - protein, 611 aa, Ajellomyces capsulatus
MLRLQARGRMPNCFKRLLFPLSCRALSATPYPYSSSSSQEKKLNSVSQHVTQPISQGASQAMLYATGLMPEDMSKAQVGISSVWYNGNPCNMHLLDLSNRVREGVQKAGLIGYQFNTVGVSDAISMGTSGMRYSLQSRDLIADSIETVMGGQWYDANISIPGCDKNMPGVVMAMGRVNRPSLMVYGGTIKPGCAVTQNNADIDIVSAFQAYGQFITGEITEAQRYDIIRHACPGGGACGGMYTANTMASAIEVMGMTLPGSSSNPAESKAKDLECLTAGEAIKTLLKEDIRPTDILTRQAFENAMVLVNITGGSTNAVLHLIAIADSVGIKLTIDDFQSVSDRIPFLADLKPSGKYVMADLHTIGGTPSLLKFLLKEGLIDGSGITVTGQTLAKNLEKVPEFPSDQKIIRPLNNPIKKTGHIQILRGSLAPEGSVGKITGKEGTKFTGKAKVYDHEDDFITALEQNEISKDEKTVVVIRYTGPKGGPGMPEMLKPSSALMGAGLGSSVALITDGRFSGGSHGFLIGHIVPEAAVGGPIALVHDGDVITIDAEKRLLDLDVSEHILAQRRKEWADRESKGLNPVTGMKMRGTLGKYARSVKDASHGCITDAL

SEQ ID NO: 443 - DNA, 1845 bp, Coccidioides immitis
atgcttcagctaaggcctcgcgggcatatgccctacaggcaattgctcacttatctctctcaccgtgccttttcttccagatcgacgttccagcagaagtcttcgtcgaatcccccgtcaaaatcaggaaagccattaaatgaagtatccagccatatcacgcagccaatctcccagggcgcttcccaggctatgctttacgctaccgggctttcgacggacgacatgtccaagcctcaggtcgggatctccagtgtctggtacaatgggaatccctgcaacatgcacctcctggacctaagcaacatcgtgcgggaaggcgtgcaaaaggcaggattgatcggatatcaattcaacaccattggtgttagtgacggaattagcatgggaacaaaaggaatgagatacagcttgcagagcagagacctaatcgccgattccatagagaccgtcatgggtggtcagtggtacgacgcaaatatcagtctgccgggatgcgataaaaacatgccgggagttatcatggctatgggtcgtgtgaaccggccgagtttgatggtatatgggggaacgatcaggccgggctgtgctgcaacacaaaacaatgctgatatcgatatcgtgtccgccttccaggcatacggccaattcttgactggggagatctccgaggagcagcgatttgatattatccgccatgcctgccctggtggtggtgcatgtggtggaatgtacaccgcaaacaccatggcttcggctatcgaggtcatgggaatgacccttccgggctcttcctccaacccagcagaatctaaggcaaagaaggccgaatgtctggctgcgggcgaagccatcaagaaccttctcatcgaggatattcgaccatccgacatcctcaccaggaccgcatttgaaaacgccatgatcttggtgaacatcactggaggctccaccaacgcggtcctccacctcattgccatggccgactccgtcggcatcaaactcaccattgatgacttccaggccgtcagcgatcgtaccccgttcctcgcagaccttaagccatccggaaagtacgtcatggctgatctgcacaacattggcggcaccccatccctgattaaattcctactgaaggagggtgtcctcgacggttcgggaatgactgttaccggtcagaccttggccaagaacgtagagaatgtccctgacttcccatctgaccaaaagatcatccgacctttcagcaacccaatcaagaagaccggccatcttcaaatcctccgtggcagcctcgctcctgaggggagtgtaggcaagatcacaggcaaagaaggaacaagtttcacaggcaaagctagagtgtatgacgatgaagatgattttattgcctctttggaacgaaacgaaattaaaaaggaagagaaaactgtcgttgttatccgatatactggaccgaagggaggaccaggaatgccagagatgcttaagccttcttctgccctgatgggtgccggattgggctcttctgttgccctcatcacggacgggcgtttcagtggtggttctcatggcttcttgatcggacacatcgtccctgaagccgcggttggcggaccaatcgccctcgttgaagacggcgacatcatcaccatcgacgccgagaagcgagttctcgatcttgaagtcggtgaagacgttctcgcgcaaagaaggaagaagtggcaggagaaacaggaggcaggcctcggtcgtccaactggattgacgatgaggggaactctgggtaaatatgccagagctgtgacggatgctagtcatggatgtatcaccgacggtgtatga

SEQ ID NO: 444 - protein, 614 aa, Coccidioides immitis
MLQLRPRGHMPYRQLLTYLSHRAFSSRSTFQQKSSSNPPSKSGKPLNEVSSHITQPISQGASQAMLYATGLSTDDMSKPQVGISSVWYNGNPCNMHLLDLSNIVREGVQKAGLIGYQFNTIGVSDGISMGTKGMRYSLQSRDLIADSIETVMGGQWYDANISLPGCDKNMPGVIMAMGRVNRPSLMVYGGTIRPGCAATQNNADIDIVSAFQAYGQFLTGEISEEQRFDIIRHACPGGGACGGMYTANTMASAIEVMGMTLPGSSSNPAESKAKKAECLAAGEAIKNLLIEDIRPSDILTRTAFENAMILVNITGGSTNAVLHLIAMADSVGIKLTIDDFQAVSDRTPFLADLKPSGKYVMADLHNIGGTPSLIKFLLKEGVLDGSGMTVTGQTLAKNVENVPDFPSDQKIIRPFSNPIKKTGHLQILRGSLAPEGSVGKITGKEGTSFTGKARVYDDEDDFIASLERNEIKKEEKTVVVIRYTGPKGGPGMPEMLKPSSALMGAGLGSSVALITDGRFSGGSHGFLIGHIVPEAAVGGPIALVEDGDIITIDAEKRVLDLEVGEDVLAQRRKKWQEKQEAGLGRPTGLTMRGTLGKYARAVTDASHGCITDGV

SEQ ID NO: 445 - DNA, 1830 bp, Botryotinia fuckeliana
atgctctcacaattgagaacgagggcaaatgcctctcttctcacctcaagaagagcttcacaatatgtgcgctctctatcgtccacatcctctctccgcacatcctccaatgactcagaaccacagctcaacagaacctcagctgctatcacacaaccaaaatcacaaggtgcttcgcaggcaatgttatatgccactggtatgaccgaggaaagattaaacaaagcacaagttggtatctcttcagtatggtggtcgggaaatccttgcaacatgcatcttttggaactcaaccacaaagtaaaggaaggagtagagagagccggtttggtaggatatcaattcaacaccattggagtttcggacggtatttctatgggtacaaagggtatgagatacagtcttcagtcaagagatttgattgcggatagtattgaaactgtgatgggtggtcaatggtatgatgccaacatttcgattcctggatgtgacaagaacatgcctggtgttatgatggcaattggcagagtcaacagaccagcccttatggtttatggtggttctattaaaccagggtgtgccgcaacacaaaacaacgcagatatcgatattgtctccgcattccaagcctacggacaattcattactggagagattacagaagaacaaagattcgatgttattcgtcatgcttgcccaggtcaaggtgcatgtggtggaatgtataccgcaaacaccatggcatcagctatcgaaattatgggaatgactcttcctggatcttctaccaaccccgcagattcaaaggccaaattacttgaatgctacgcagctggtggtgcaatcaaaactcttctcaaggaggacatcagacctagagatatcatgacaagacaggctttcgaaaatgctatggttcttgttaccattactggaggatctaccaacgctgttcttcatcttattgctatggcagatgctgtaggaatcaagctcacaatcgatgatttccaagctgtttctgaccgaacacctttcctcgcagacctcaaaccatctggtaaatacgtcttcaatgatctttacagcatcggtggtactccttctcttatcaaactcctcatcaaggaaggtgtcattgatggatcaggaatgactgttactggtaagacccttgctgagaacgtcaaggatgttcgtgatttcccatccgaccaagaaattattcgcccattctcaaaccccatcaaaaagtctggtcacattcaaattctccgcggttccctcgcaccaggtggatccgttggtaaaatcaccggtaaagaaggattacgattcgttggaaaagctaaggtttatgatgctgaaaatgatttcatcgaagcccttgagcgtggcgaaatcaagaagggagagaagaccgttgtagtcattcgttatgaaggaccaaagggtggaccaggtatgccagaaatgttaaaaccatcctcggcaatcatgggtgcaggacttggaaaggatgtcgctcttattaccgatggacgtttcagtggaggatctcatggattcttgattggacatattgtaccagaggcacaagtcggtggaccaattggattggttagggatggtgatactattgttattgatgctgagacgagagtattggatttggaagttgagggtggtgaggaggaattggagaggaggagaaaagaattcgtcgcacctcctttgaaatataccaagggtactttggcgaaatactcgagattggtacaagatgctagtcatggatgtattaccgatggagaaatcgttgaggcatga

SEQ ID NO: 446 - protein, 609 aa, Botryotinia fuckeliana
MLSQLRTRANASLLTSRRASQYVRSLSSTSSLRTSSNDSEPQLNRTSAAITQPKSQGASQAMLYATGMTEERLNKAQVGISSVWWSGNPCNMHLLELNHKVKEGVERAGLVGYQFNTIGVSDGISMGTKGMRYSLQSRDLIADSIETVMGGQWYDANISIPGCDKNMPGVMMAIGRVNRPALMVYGGSIKPGCAATQNNADIDIVSAFQAYGQFITGEITEEQRFDVIRHACPGQGACGGMYTANTMASAIEIMGMTLPGSSTNPADSKAKLLECYAAGGAIKTLLKEDIRPRDIMTRQAFENAMVLVTITGGSTNAVLHLIAMADAVGIKLTIDDFQAVSDRTPFLADLKPSGKYVFNDLYSIGGTPSLIKLLIKEGVIDGSGMTVTGKTLAENVKDVRDFPSDQEIIRPFSNPIKKSGHIQILRGSLAPGGSVGKITGKEGLRFVGKAKVYDAENDFIEALERGEIKKGEKTVVVIRYEGPKGGPGMPEMLKPSSAIMGAGLGKDVALITDGRFSGGSHGFLIGHIVPEAQVGGPIGLVRDGDTIVIDAETRVLDLEVEGGEEELERRRKEFVAPPLKYTKGTLAKYSRLVQDASHGCITDGEIVEA

SEQ ID NO: 447 - DNA, 1692 bp, Phaeosphaeria nodorum
atgtctctcgcacgctttggaggcgcactttcacgtcccaagtcgcagggcgcctcgcaggccatgctgtacgcgactggcatgagcgaggatgatatgaataaggcccaggtcggcatctcatcagtgtggtactcgggcaacccatgcaatatgcacctgatggacctcaacaacaaggtcaaagagggtgtgcagcgggctggtctcttgggcatgcagttcaacaccattggtgtgagtgacggcatttccatgggcaccaagggcatgcgctactcgctgcagtcgcgtgagatcatcgcagactcgattgagactgtcatgggcggccaatggtacgatgcgaacatttccatccccggatgcgacaagaacatgcccggtgtcatcatggctatgggccgtgtgaaccggccctcgctgatggtctacggcggaaccatccagcctggatgcgcaaagactctcgacaaccagtccatcgacatcgtctctgccttccaggcctacggacaattcataactggagagatcactgaagaccagcgcttcgatgtcatcagacacgcatgcaacggtcagggtgcttgtggaggcatgtacacggcaaacacaatggctactgccattgagaccatgggcatgtcgctgcccggctcatcgtcgaaccccgccaactcgcaggccaagatgctggaatgcctggctgcgggaggcgcaatcaagaacctgctcaaggaggacctgcgccccagcgacatcctcaccaggcaagcactcgagaacgccatggttgtcatcagcatcaccggaggctccaccaacgccgtattacacctgatcgccatcgccgactctgttggtctcaaactgaccatcgacgacttccagagcgtgagcgaccggattccgttgctcgctgatctcaagccctctggcaagtacgtcatggctgatgttcacgacatcgggggtactcccgcactgctcaagttcctgcttaaggagggcctgctcgacggcagccagatgactgtcactggcaagaccctaaagcagaacttggagaacgtcaaggacttcccctccgaccagaagatcatccgccctctcagcgagcccctcaagactaccggccatttgcaaattctccgtggtagtctcgcaccaggtggctgtgtcggcaagatcaccggcaaagaaggaaccatcttcaccggcaaagccaaatgctacgatgccgaagacgacttcatcagtgcgctcgagcgcggcgagatcaaaaagggcgagaagactgtcgtcgtcatccgctacgaaggccccaagggcgggcccggcatgcctgaaatgctcaagcccagctccgccatcatgggcgcaggtctcggcaaggatgtcgcactcatcactgacgggcgcttcagcggtggtagccacggtttcttgatcggccacattgtgcctgaagcgcaggagggcggaccgatcggtcttgtccaggatggcgatgagatcaccatcgactctgagtcgaatgaacttaacattggcgtgagcgagcaggagttggcggagcgcaggaagagctggaaggcgccggcgctgaagtatcaaaagggcacgctgttcaagtatgcgcggttcgtcaaggacgccagctcgggatgcgtgacggactcggcataa

SEQ ID NO: 448 - protein, 563 aa, Phaeosphaeria nodorum
MSLARFGGALSRPKSQGASQAMLYATGMSEDDMNKAQVGISSVWYSGNPCNMHLMDLNNKVKEGVQRAGLLGMQFNTIGVSDGISMGTKGMRYSLQSREIIADSIETVMGGQWYDANISIPGCDKNMPGVIMAMGRVNRPSLMVYGGTIQPGCAKTLDNQSIDIVSAFQAYGQFITGEITEDQRFDVIRHACNGQGACGGMYTANTMATAIETMGMSLPGSSSNPANSQAKMLECLAAGGAIKNLLKEDLRPSDILTRQALENAMVVISITGGSTNAVLHLIAIADSVGLKLTIDDFQSVSDRIPLLADLKPSGKYVMADVHDIGGTPALLKFLLKEGLLDGSQMTVTGKTLKQNLENVKDFPSDQKIIRPLSEPLKTTGHLQILRGSLAPGGCVGKITGKEGTIFTGKAKCYDAEDDFISALERGEIKKGEKTVVVIRYEGPKGGPGMPEMLKPSSAIMGAGLGKDVALITDGRFSGGSHGFLIGHIVPEAQEGGPIGLVQDGDEITIDSESNELNIGVSEQELAERRKSWKAPALKYQKGTLFKYARFVKDASSGCVTDSA

SEQ ID NO: 449 - DNA, 1758 bp, Pichia guilliermondii
atgttatctgctagagtacattctagactattttccacttcggtggtccgttgtgagaaagtgctcaacaagtactcttcgatcgtgacccaggataagtctcaaggtgcttcgcaagccatgttgtatgctacgggctttcaagatgaagatttcgataaggctcaaattggagttggaagtgtatggtggtcaggaaacccttgtaatatgcacttgatggacatgaacgacagatgtacagcttctgtgaacaaggctggattgaaaggaatgcaattcaattccattggagtttctgatggtatcaccaacggtactgatggtatgagatattcattacaatcgagagaaatcattgccgattcatttgagactttagtgatggcccagatgtatgatggtaacattgccattccatcgtgtgacaagaatatgcctggtactcttatggctatgggtagacacaatcgtccatcgattatggtttatggtggtactatcatgcctggatctccttcttgtggtggtgcaaatgttcctgagaagattgatatcattagtgctttccaatcttatggtcaatttttgagtggacagatcaatgaggaacaaagaaaggacattgtaagacatgcttgtccaggtgctggtgcttgtggtggtatgtataccgccaacaccatggcttctgctgctgaggtcatgggtatgtcacttccatactcttcttcagctcctgccatttcgaaagaaaaagctgatgagtgtgacaatgttggttatgccatgaaacatttattagaaattgatttgaaacccaaggatataatgactaaaaagtcctttgagaatgccatcacctacatcattgccactggtggttccacaaatgcggtgttgcacttgattgccattgctcattctgtgggtattgacttgactgttgatgacttccaacgtatttctgataccactccattgttggctgatttcagaccatctggtaaatacgttatggcagatcttcaacaatttggaggtactcctgcggtgatgaaattgttgttggaagaaggtttcctcgatggagaccagtacaccgtcaccggtaataccatcaaagaaaacttatcaaaggtcaagggattgccagccagtcaagacattgttcgtcctgtttctaacccattgaaaccaaatggacacttgcaaattctcaagggtactttagcaccaggaagtgccgttggtaagattactggtaaagaaggtacctactttaagggagctgccagagtgtttgacaatgaagaattgttcatcaaggctcttgaaaagggagagatcaagaagggagaaaagaccgtttgtgtgattcgttatgagggccctaagggtggtcctggtatgcccgaaatgttgaaaccttcttcagcattgatgggttatggtttgggtaaagacgttgcattgttgactgatggtaggttctctggtggttctcatggtttcttgattggtcacatcgtgccagaagccgccgagggtggcccaattgccttggttcacgacggagatgagattgtcattgatgctgaaaacaacaaaattgacttgcttgtctcggaagaaattctcgctgaaagaaagaagctgtggtctcctcctgctccaagatacacgagaggaaccttggccaagtactccaaattggttagtgatgcttccaccggttgtgtaactgacttggactaa

SEQ ID NO: 450 - protein, 585 aa, Pichia guilliermondii
MLSARVHSRLFSTSVVRCEKVLNKYSSIVTQDKSQGASQAMLYATGFQDEDFDKAQIGVGSVWWSGNPCNMHLMDMNDRCTASVNKAGLKGMQFNSIGVSDGITNGTDGMRYSLQSREIIADSFETLVMAQMYDGNIAIPSCDKNMPGTLMAMGRHNRPSIMVYGGTIMPGSPSCGGANVPEKIDIISAFQSYGQFLSGQINEEQRKDIVRHACPGAGACGGMYTANTMASAAEVMGMSLPYSSSAPAISKEKADECDNVGYAMKHLLEIDLKPKDIMTKKSFENAITYIIATGGSTNAVLHLIAIAHSVGIDLTVDDFQRISDTTPLLADFRPSGKYVMADLQQFGGTPAVMKLLLEEGFLDGDQYTVTGNTIKENLSKVKGLPASQDIVRPVSNPLKPNGHLQILKGTLAPGSAVGKITGKEGTYFKGAARVFDNEELFIKALEKGEIKKGEKTVCVIRYEGPKGGPGMPEMLKPSSALMGYGLGKDVALLTDGRFSGGSHGFLIGHIVPEAAEGGPIALVHDGDEIVIDAENNKIDLLVSEEILAERKKLWSPPAPRYTRGTLAKYSKLVSDASTGCVTDLD

SEQ ID NO: 451 - DNA, 1782 bp, Debaryomyces hansenii
atgagtgcattgacaaagtgtaaacgtaacttaggaggtagaaacatccggttattttccaattctgctttgaattgtgacaacaagttaaataagtactcttctattgtgacccagcccaagtcgcaaggggcatcccaagcgatgttgtatgcgaccgggtttgatgaagaagatatgaacaaggcacaggttggtgttggatctgtctggtggtcaggaaatccgtgcaacatgcacttgatggagatgaacaacaaggtgaccgaatctgttaacagagccggtttgaaggggatgcagttcaactcgattggtgtctcggatgggatcactaatggtactgatggtatgagatactcgttgcaatcgcgtgaaattattgctgactcgtttgagaccatgatgatggcccagatgtacgatgccaacatcgcaattccgctgtgtgacaagaacatgccaggtaccttgatggctatgggtagacacaacagaccatctattatggtttacggtggtactattatgccaggttctccaacttgtggtaactcgattattcctgacaagattgatatcatctctgcgttccaatcgtatggtcaattcttatcggaccagatcaatgagggcgaaagaaaggatatcattaagaatgcatgtcctggtgctggtgcatgtggtggtatgtacactgccaacaccatggcctctgctgctgaagttttaggtatgtccttaccattttcgtccagtgccccagccatttcgaaggaaaaggcacatgaatgtgctactgtcggtgatgccatcaagaatttgttagtccttgacttgaagccaatggatatcatgaccaagaaggcttttgaaaatgcaatcacttatattatcgctactggtggttctactaatgccgttttacatttgattgccatggcaaacaccgttggtgttgacttaactgtcgatgatttccaaagaatttcggactccactccattattagccgatttcaagccaagtggtaagtacgttatggctgacttacaaaagtacggtggtaccccagctgtcatgaagttgttattcgaggaaggtttaattgatggatctcaatatactgtcacaggtaagactatcaaagaaaatttggaatctgttaaaggcttgccagctgaacaagaaattgtcagacccttatctaacccattaaagccaagtggccacttacaaattttaaagggtactttagctccaggtagtgctgtcggtaaaattactggtaaggaaggtacttatttcaagggtaaatctagagttttcgatgatgaaatggcattcattactgctttagaaaatggcgaaatcaagaaaggtgaaaagactgtttgtgtcattagatacgaaggtcctcaaggtggccctggtatgccagagatgttgaagccttcttctgcattaatgggttacggtttaggccaagacgttgcgttattaactgatggtagattctctggtggctctcatggtttcttaattggtcatattgttccagaagctgcagttggtggaccaattgcgttagtgcatgatggtgatgaaattgttattgacgctgaaaacaatagaatcgacttattagtatctgaagatattttagccgaaagaaagaaggaatggaccccaccaaagccaagatatacaagaggtacattggctaaatattctaagttagtcagtgatgcttcgttgggttgtgttactgatttggtataa

SEQ ID NO: 452 - protein, 593 aa, Debaryomyces hansenii
MSALTKCKRNLGGRNIRLFSNSALNCDNKLNKYSSIVTQPKSQGASQAMLYATGFDEEDMNKAQVGVGSVWWSGNPCNMHLMEMNNKVTESVNRAGLKGMQFNSIGVSDGITNGTDGMRYSLQSREIIADSFETMMMAQMYDANIAIPLCDKNMPGTLMAMGRHNRPSIMVYGGTIMPGSPTCGNSIIPDKIDIISAFQSYGQFLSDQINEGERKDIIKNACPGAGACGGMYTANTMASAAEVLGMSLPFSSSAPAISKEKAHECATVGDAIKNLLVLDLKPMDIMTKKAFENAITYIIATGGSTNAVLHLIAMANTVGVDLTVDDFQRISDSTPLLADFKPSGKYVMADLQKYGGTPAVMKLLFEEGLIDGSQYTVTGKTIKENLESVKGLPAEQEIVRPLSNPLKPSGHLQILKGTLAPGSAVGKITGKEGTYFKGKSRVFDDEMAFITALENGEIKKGEKTVCVIRYEGPQGGPGMPEMLKPSSALMGYGLGQDVALLTDGRFSGGSHGFLIGHIVPEAAVGGPIALVHDGDEIVIDAENNRIDLLVSEDILAERKKEWTPPKPRYTRGTLAKYSKLVSDASLGCVTDLV

SEQ ID NO: 453 - DNA, 1794 bp, Lodderomyces elongisporus
atgagtttcgctagcaccacaagaaggtgttgcactagatcttttgcctcctccactgttcgtcatgaattagaaaagaaaccattgaaactcaacaagtactcttccgttgtcaccgaggacccttcccaaggagcatcgcaagcaatgctctacgccacagggttctcctccgaggactttaaccgtgcacaaatcggtgtcggatccgtttggtggaccggtaacccttgtaacatgcacttgatggagttaaacaatatgtgtgcagagtcagtcaacaaggccggtttaaaagcaatgcaattcaactcaattggtgttagtgatggtatcaccaacggtacagagggtatgaaatactcattgcaatcacgtgaaatcattgctgactcatttgaaacaatgaccatggctcaattatatgacggtaatgttgccatcccaagttgtgacaagaatatgcccggtgtccttatggcaatgggtagacacaatagacccgccattatggtgtacggaggtacaatcatgcccggctcaccaacttgcggtggctcaaagctgaatcccgccattgcagataagattgacattatcagtgctttccaaagttatggacaattcttgtccaaacaaatcaacgaggaagaaagaattgatattgtgaaaaacgcatgtcctggaccaggtgcttgcggtggtatgtacactgccaacactatggcctctgcagccgaagtcttgggtttaactttacctttttcatcatcggcaccagcagtttcaaaagaaaaggccgaagagtgtgccaacgttgggtacgccatcagaaacttgcttgaactcgacttgaaaccaagagacattttgaccaaaaaatcatttgaaaacgccatcacatacatcattgctaccggtggctcaacaaatgcagttttgcacatgattgccattgcttcaagcttcgatatcgaattaactgttgacgatttccaaagaatcagtgactctactccacttttggctgactttaaaccatctggtaaatacgttatggcagatttgcaagctattggtggtacaccagcagttatgaagtttttgatgaatgaaggtatgattgatggttcgcaattgactgtgacaggtaagaccattgctgaaaacttggccaatgttccagaattgccaaagggtcaagaaatcatccactcattggacaacccattgaaaccaagcggtcacttgcaaatcttgaaaggaaccttggccccaggctcagccgttgccaagattactggtaaagaaggtacttacttcaaaggtaaagctagagtttttgacgaggaacacgcatttatcactgcattggaaaatggcgagatcaaaaagggtgaaaagactgtttgtgtcattagatacgaaggaccaaaaggtggtccaggtatgccagaaatgttgaaaccatcaagtgctttgatgggatacggattgggacaagatgttgccttattgaccgatggtagattttctggtggttcacacggattcttgattggtcacattgtccccgaggcagccgaaggtggtccaattgctcttgttgaggatggcgatgagattgttattgatgccgacaagaacatcattgacttgttggtgagcgaagacgtcttggccaagagaagagagcaatggactccacctgaacccagatacaaaagaggtacattgttcaaatatgccaaattggttagtgatgcttccaaaggatgtgttactgacttgtaa

SEQ ID NO: 454 - protein, 597 aa, Lodderomyces elongisporus
MSFASTTRRCCTRSFASSTVRHELEKKPLKLNKYSSVVTEDPSQGASQAMLYATGFSSEDFNRAQIGVGSVWWTGNPCNMHLMELNNMCAESVNKAGLKAMQFNSIGVSDGITNGTEGMKYSLQSREIIADSFETMTMAQLYDGNVAIPSCDKNMPGVLMAMGRHNRPAIMVYGGTIMPGSPTCGGSKLNPAIADKIDIISAFQSYGQFLSKQINEEERIDIVKNACPGPGACGGMYTANTMASAAEVLGLTLPFSSSAPAVSKEKAEECANVGYAIRNLLELDLKPRDILTKKSFENAITYIIATGGSTNAVLHMIAIASSFDIELTVDDFQRISDSTPLLADFKPSGKYVMADLQAIGGTPAVMKFLMNEGMIDGSQLTVTGKTIAENLANVPELPKGQEIIHSLDNPLKPSGHLQILKGTLAPGSAVAKITGKEGTYFKGKARVFDEEHAFITALENGEIKKGEKTVCVIRYEGPKGGPGMPEMLKPSSALMGYGLGQDVALLTDGRFSGGSHGFLIGHIVPEAAEGGPIALVEDGDEIVIDADKNIIDLLVSEDVLAKRREQWTPPEPRYKRGTLFKYAKLVSDASKGCVTDL

SEQ ID NO: 455 - DNA, 1764 bp, Vanderwaltozyma polyspora
atgactattgcaagcaaggcattgagtgctagacacttttcagtcactagaaatgttagtaagaagttgaataagtactcttatatcgttacagaacctaaggaccaaggtgcatcacaagcgatgctttatgcaactgggttcaagaaagaagattttagtaaaggtcaagttggtgtaggatcatgttggtggtctggtaatccatgtaatatgcatttattggatcttaatgatagatgttcacgttctgtggagaaggctggcttgaaagctatgcaatttaataccattggtgtttccgatggtatttcaatgggtactaaaggtatgagatactctttacagagtagagaaatcattgctgattcttttgaaactataatgatggctcaacattacgatgccaatattgctatcccttcatgtgataaaaacatgccgggtgtcatgatggccatgggaagacataacagaccttctatcatggtttatggtggtactattttacctggccatccaacctgtggttcttcaaaaattccagaaaacattgatatagtatctgctttccaatcttatggtcaatatatatctaaacaattcagcgaacaagagagagaagatgtggttgaacatgcttgtcctggtccaggttcttgtggtggtatgtatactgctaacactatgggttctgtcgcagaagtgctaggtttgactttgccaaactcttctgccttcccagcagtttctcaagaaaagatgaatgaatgtgattccattggtgaagctattaagaagacaatggaattaggtatcactcctcgtgatatcatgactaagcaagcttttgaaaatgcaatcacctatgttatcgcaaccggtggttccaccaatgctgttttgcacttggttgccattgctcattctgctggtgtcaagattactcctgatgatttccaaagaatcagtgataagaccccattattgggtgattttaaaccatcgggtaaatacgttatggctgatttaatcaaagtaggaggtacccaatctgttatcaaattcttgtacgaaaacggtttcttgcatggtgatgccattactgttactggtgatacattagccgaacgtgctgccaaaacttctggattaccagaaggccaagatataatcagacctgtttcacaacctattaaaccaaatggccatctacaaatattgtatggctcattggctccaggtggtgctgtcggtaaaatcactggtaaagaaggtactttctttaaaggtagggctcgtgtttttgaagaagaagaagctttcattcatgcattggaaagaggtgaaattaagaaaggtgaaaaaaccgttgttgtcatcagatatgaaggtccaaaaggtggtccaggtatgccagaaatgttgaaaccatcctctgcgctaatgggttacggtttaggtaaagatgttgccttgttaactgatggtagattttctggtggttcccatggattcttaatcggtcacattgttccagaagctgccgaaggtggtccaattggtttagttaaagatggagacgaaattgttattgatacaaataacaacaagatagatttattagtatccgaacaagaaatagcccaacgtaaatcagagtgggttaaaccagctccacgttacaccagaggtactctatccaagtacagtaaattggtatctaacgcttctaacggttgtgtattagacgctgacaattga

SEQ ID NO: 456 - protein, 587 aa, Vanderwaltozyma polyspora
MTIASKALSARHFSVTRNVSKKLNKYSYIVTEPKDQGASQAMLYATGFKKEDFSKGQVGVGSCWWSGNPCNMHLLDLNDRCSRSVEKAGLKAMQFNTIGVSDGISMGTKGMRYSLQSREIIADSFETIMMAQHYDANIAIPSCDKNMPGVMMAMGRHNRPSIMVYGGTILPGHPTCGSSKIPENIDIVSAFQSYGQYISKQFSEQEREDVVEHACPGPGSCGGMYTANTMGSVAEVLGLTLPNSSAFPAVSQEKMNECDSIGEAIKKTMELGITPRDIMTKQAFENAITYVIATGGSTNAVLHLVAIAHSAGVKITPDDFQRISDKTPLLGDFKPSGKYVMADLIKVGGTQSVIKFLYENGFLHGDAITVTGDTLAERAAKTSGLPEGQDIIRPVSQPIKPNGHLQILYGSLAPGGAVGKITGKEGTFFKGRARVFEEEEAFIHALERGEIKKGEKTVVVIRYEGPKGGPGMPEMLKPSSALMGYGLGKDVALLTDGRFSGGSHGFLIGHIVPEAAEGGPIGLVKDGDEIVIDTNNNKIDLLVSEQEIAQRKSEWVKPAPRYTRGTLSKYSKLVSNASNGCVLDADN

SEQ ID NO: 457 - DNA, 1746 bp, Ashbya gossypii
atgatgtctcacaggcggttctcgacagcgcagcggctgcgcgaggggctaaacaggtactcgagggtcataaccgagccgcgggcgcagggtgcctcgcaggccatgctgtacgcgactggtttcggtgatggggactttgcaaaggcgcaggtcggagtggggtcgtgctggtggtcgggcaacccatgcaacatgcatctgatggacctgaataaccgggtagcggcgtctgtggaccgggcgggcttgaaggcgatgcagttcaacacaatcggtgtctcggacggcatttctatggggactaccggcatgcggtactcgctgcagtcgcgcgagatcattgcagactcttttgagaccatgatgatgggtcagcactacgatggcaacgtggcaattccctcctgcgacaagaacatgcccggcgtgataatggccatggcgcggcacaaccggccctccattatggtctacggcggcaccatcatggcggggtccccttgcagcggctctacgcggctgccaaagaagattgatgttgtatctgcgttccaggcgtacgggcaatatctgtcgaagcagattacggaggaggaaagcagggatgtcgtccgtcacgcctgtccgggtccgggctcttgcggtggcatgtacacagccaacacaatggcctcagccgccgaggttctgggactgactctgcccaactcgtctgcgttcccggcgatctccgaacagaagctggccgaatgtgacgccgttggggatgccatgcgcaaagcgctcgagctcaacatcaggccacgcgacctgctcacaagggaagccttcgaaaacgcgatcacgtacgtgattgcgactggtggctcgaccaacgcagtgctccacctggttgctattgcccactctgcgggcgtgaaactgacgccggatgacttccagcgcatttccaacaaaactccgttgctgggcgacttcaagccatccggaaagtacgtcatggctgacctcattgaggttgggggtacacaggccgtcatcaagtttttgtatgaaaatggcttcatgcacggagatgccctaacggtgacaggagacacgctcaaggagcgggctgcgaagactgctcccttgcccgaaggccaggacatcattcgtcccgtgtcgcagccattgaatcctaggggacatctccagattctctatggctctcttgcgccaggcggcgctgtcggcaagatcaccgggaaggaggggaccttcttccagggccgcgcacgcgttttcgatgaagaaaacgcattcatccgcgccctggaggagggccagatcaagaagggtgagaaaaccgttgtggtcatcaggtatgaaggccccaagggtgggcccggcatgccagaaatgctcaaaccgtcttccgcgctgatgggctacggtctgggcaacgatgttgccttgctgaccgacggccgcttctccggcggctcccacgggtttttgatcggccacattgtccctgaggcctatgaaggcggcccaattgcgctcgtgcaagacggtgacgacattgtcatcgacgccgagaacaatgccatcaacctccttgtgccaaaagaagaaattgagtcgcgccgcgctcgctggacccagccggctccacgctacaagaggggcacgctcgccacctattctaagttagtctccaacgcctccaagggttgtgtcttggacagcgacgactag

SEQ ID NO: 458 - protein, 581 aa, Ashbya gossypii
MMSHRRFSTAQRLREGLNRYSRVITEPRAQGASQAMLYATGFGDGDFAKAQVGVGSCWWSGNPCNMHLMDLNNRVAASVDRAGLKAMQFNTIGVSDGISMGTTGMRYSLQSREIIADSFETMMMGQHYDGNVAIPSCDKNMPGVIMAMARHNRPSIMVYGGTIMAGSPCSGSTRLPKKIDVVSAFQAYGQYLSKQITEEESRDVVRHACPGPGSCGGMYTANTMASAAEVLGLTLPNSSAFPAISEQKLAECDAVGDAMRKALELNIRPRDLLTREAFENAITYVIATGGSTNAVLHLVAIAHSAGVKLTPDDFQRISNKTPLLGDFKPSGKYVMADLIEVGGTQAVIKFLYENGFMHGDALTVTGDTLKERAAKTAPLPEGQDIIRPVSQPLNPRGHLQILYGSLAPGGAVGKITGKEGTFFQGRARVFDEENAFIRALEEGQIKKGEKTVVVIRYEGPKGGPGMPEMLKPSSALMGYGLGNDVALLTDGRFSGGSHGFLIGHIVPEAYEGGPIALVQDGDDIVIDAENNAINLLVPKEEIESRRARWTQPAPRYKRGTLATYSKLVSNASKGCVLDSDD

SEQ ID NO: 459 - DNA, 1704 bp, Laccaria bicolor
atgaaccggcacagcagggtggtcacccaacccaaagaccaaggtgctagtcaggccatgctgtatgctacggacggcatcaaaacggatgatgacttcaacaaagccatggtcggcgtcgccagcgtctggtacgagggtaatccatgcaataaacatctccttggtctgggtcaagaaatcaaagcttcacttacaaagtctggtatcataggctaccagtttggtaccgttggagtcagcgatgggatcagcatgggaacgcgcggcatgtcctactccctccaatcccgagacctgattgcagatcaagtagagaccgctgccggaggacaccatctcgacgggatggtcgtcgttcccggctgcgataaaaatatgcctggtgttctgatggcccttgggcgtctcaaccgccctggacttatggtgtatggtgggacaattcgtgccgggtcgtgtgaaggagcgccacagttggacatcgtgtccgctttccagtcctacggaaagtacctgcaggacggaaagacacccgaagcggaacgcgaacgatataataccgttcgacatgcctgcccaggaccaggcgcttgtggtggtatgtacacagcaaacactatggcaagtgcggcggaggcactggggatgacagtccccggatcatcatccttcccagccgaatccctggaaaaacacaacgagtgtgcttcgattgggaaagttatgtacaaccttcttgagaaaaacatacttccacgggatatcatgactagatccgcgtttgaaaatgctatggtcctcacgatgattctaggcggttccaccaatgcagttctccatctaatagctatggctcactccgtgggcattaaattggatatcgacgacttccaaaacgtgtcagaccgcacccccttcctcgccgacatcaaacccagtggcaaatatgtcatggaagatgtgtacaagatcggtggaatcccaaaaattttggcgttcttgctaaagaacaagctaatcgacggaaataatatgactgtcacgggtcgaaccctcggcgaaaaccttgaggaatggacacacagatacggcgaactggattctcgacaagacgttattcgacctctcaacaaacccataaaagagacagggcacatccgaatcctcaaaggcaatcttgctcctggcggtgcggtggctaagatcacaggcaaagaaggcttggaatttactggcaaggcacggactttcgacacagaagacgatttcgtcaaggccgtcgaaagcgggtctatcaaaaagggtgaaaaaacggtcgtcattcttcggtatctcggccctcagggaggacctggcatgcctgagatgctgaaacccacaagcttaatcatgggagccggcttgggattggacgttgcctgtctcacagatggaagattcagcggcggatcccatgggttttgtattggacacgtcgttcccgaggcacaggttggtgggcccatagcgctcgtcagggacggagacaccattgtcgtcgatgccatcaagaacactatcgagctccgcgtctcacccgaggagttaacgaagagaaaagagtcttggattccacctgccctcaaggtatcccagggaacgttgtacaagtatactaagagtgttacagacgcgagccatgggtgtgtgacggacgcatga

SEQ ID NO: 460 - protein, 567 aa, Laccaria bicolor
MNRHSRVVTQPKDQGASQAMLYATDGIKTDDDFNKAMVGVASVWYEGNPCNKHLLGLGQEIKASLTKSGIIGYQFGTVGVSDGISMGTRGMSYSLQSRDLIADQVETAAGGHHLDGMVVVPGCDKNMPGVLMALGRLNRPGLMVYGGTIRAGSCEGAPQLDIVSAFQSYGKYLQDGKTPEAERERYNTVRHACPGPGACGGMYTANTMASAAEALGMTVPGSSSFPAESLEKHNECASIGKVMYNLLEKNILPRDIMTRSAFENAMVLTMILGGSTNAVLHLIAMAHSVGIKLDIDDFQNVSDRTPFLADIKPSGKYVMEDVYKIGGIPKILAFLLKNKLIDGNNMTVTGRTLGENLEEWTHRYGELDSRQDVIRPLNKPIKETGHIRILKGNLAPGGAVAKITGKEGLEFTGKARTFDTEDDFVKAVESGSIKKGEKTVVILRYLGPQGGPGMPEMLKPTSLIMGAGLGLDVACLTDGRFSGGSHGFCIGHVVPEAQVGGPIALVRDGDTIVVDAIKNTIELRVSPEELTKRKESWIPPALKVSQGTLYKYTKSVTDASHGCVTDA

SEQ ID NO: 461 - DNA, 1797 bp, Coprinopsis cinerea
atgccgccaaaatatctcccaattcgtcgtcaatggctccggtcagcgagaggcttgtctacaaccgcacggtgcagtgacaagcccgtcctgaaccggtacagcaggatcatcacccagcccaaggaccagggagcaagtcaggctatgctctatgctacagatggcataaagtcggacgcggacttcaacaagccgatggtcggtgtcgccagcgtatggtatgagggcaacccatgcaacaagcaccttctcggacttggccaggaaatcaaggcttcccttaccgaggcagacatcataggctaccagtttggtacggtcggtgtcagcgacggtattagtatgggtacgaaaggaatgtcgtattccctccagtcgcgagacttaatcgctgaccaggtggaaactgctgccggaggtcatcatctcgatggcatggtagtagtccctgggtgcgacaagaatatgcctggtgttctcatggctcttggccgtctcaaccgaccaggtctcatggtctacggtggaaccattcgcgcaggctcgtgtgaaggcatgcctcaattggatatcgtttctgctttccaggcctacggaaaataccttcaagacggaaggacacccaaggctgaggaagaacgatacaacaccgttcgacacgcctgtcctggtcctggtgcttgcggtggcatgtacactgcaaacacaatggcaagtgcagcggaggctttgggaatgacccttcccggttcttcctccttcccagcgcagtcagaggagaaacatctagagaccaagtctatcggttctgtgatgtacaacttgcttgagaagaacattttgccgagggacatcatgacgcgctctgcctttgaaaacgcgatggtcctcaccgtcatcctcggaggctcaaccaacgcagtcctccatttgatcgccattgctcactcagtcggcatcaaactcgacattgacgacttccaaaaggtgtccgaccggatacccttccttgccgacttgaagcccagcggaaaatatgtcatggaagatgtctacaagatcggtggtatccccaaggttctcgcgttcttgctcaagaacaatttgatcgatggtaataacatgactgttactggtcgcactgtcggagagaacttggaccgatggacgcacaagtacggcgagctccacttcgacaagcaggatgtcatccgacctctggataagcctatcaaggagactggtcacatccggattttgaagggtaacctcgcccctggtggcgccgtcgccaaaatcaccggaaaagaaggccttggtttcgtcggcaaagcacgtgtatttgattctgagaacgacttcgtcaaggctgtggaatctggtagcatcaagaagggcgagaaaaccgttgttattttgcggtatctcggtcctcagggtggacctggaatgcccgagatgcttaagcctaccagtttggtgatgggcgctggattgggtatggatgtcgccatcttgactgacggacgatttagcggaggatcgcacggattctgtatcggacacgtcgttccggaagcgcaagtcggtggccctatcgccttggtcgaggacggcgacatcatctcggttgacgctgtgaagaacacgatcgagttgcaggtccctgaacccgagcttgccgcgcgaaaggctgcatggaaggcaccccctctcaaggtcacccagggcaccctctacaaatacgccaaggttgtcaccgatgccagccatgggtgtgtcactgatgcttaa

SEQ ID NO: 462 - protein, 598 aa, Coprinopsis cinerea
MPPKYLPIRRQWLRSARGLSTTARCSDKPVLNRYSRIITQPKDQGASQAMLYATDGIKSDADFNKPMVGVASVWYEGNPCNKHLLGLGQEIKASLTEADIIGYQFGTVGVSDGISMGTKGMSYSLQSRDLIADQVETAAGGHHLDGMVVVPGCDKNMPGVLMALGRLNRPGLMVYGGTIRAGSCEGMPQLDIVSAFQAYGKYLQDGRTPKAEEERYNTVRHACPGPGACGGMYTANTMASAAEALGMTLPGSSSFPAQSEEKHLETKSIGSVMYNLLEKNILPRDIMTRSAFENAMVLTVILGGSTNAVLHLIAIAHSVGIKLDIDDFQKVSDRIPFLADLKPSGKYVMEDVYKIGGIPKVLAFLLKNNLIDGNNMTVTGRTVGENLDRWTHKYGELHFDKQDVIRPLDKPIKETGHIRILKGNLAPGGAVAKITGKEGLGFVGKARVFDSENDFVKAVESGSIKKGEKTVVILRYLGPQGGPGMPEMLKPTSLVMGAGLGMDVAILTDGRFSGGSHGFCIGHVVPEAQVGGPIALVEDGDIISVDAVKNTIELQVPEPELAARKAAWKAPPLKVTQGTLYKYAKVVTDASHGCVTDA

SEQ ID NO: 463 - DNA, 1791 bp, Cryptococcus neoformans
atgctttcaagacgcatcgctactgcaagcccagccgctcatactagagcattccatgcgtcggctgccaaggcctcgaaagaggtcataatgaatcgttactctaggactattactcaacctaaggctcaaggcgcttctcaggccatgctttacgccacggaaggcattgtgaatgacgaagacttcaataaggccatggttggcgttgccagtgtttggtacgaaggcaacccatgcaatcgacacattttgggccttggccagagggtgaagaagtctcttatgaatgctggcatcgttggctaccaatttggtactgtcggtgtctctgacggtattagcatgggtacctctggaatgtcttactccctgcaatctcgtgacctcattgccgactctgttgagacggctgctggtggtcattggctggatgggatggtcgttttacctggttgcgataaaaacatgcctggtgctttgattgctctcggtcgacttaatcgacccagtatgatggtttatggcggtactatccgtcctggctcttgtggcggagaggtgctcgacattgtgtcagctttccagagttatggacgatacctccaagaaggccaaacacctgaggctgaaaagacccgctacaataccattcgaaacgcatgtcctggtcctggagcctgtggaggcatgtacactgctaacacaattgcgtccgcctccgaagccttgggtatgactcttcctgggtcgtcgtctttccctgcggaatatcctgaaaagcatgcggaatgtgacgctgttggcgagactatgcgcaaggttttggaagataaccttctccccagacaaatcatgaccaggcaggctttcgaaaatgcaatggctcttacaatggcgctcggtggatctaccaacgttgttctccatttgatcgccatcgctcggtcggttggtatcaaccttaccattgacgatttccaaacggtctccgatcgagtacctttgctggccgatctcaaacccagtggtaaatacgttatggaagacatcaacaccatcggtggcacgccttccgtcattcactatctgatcaaaaacggaattatgaccggtgacgagatgaccatcaccggtaagactcttggagagaattgtgatcgctgggtggaggagcacggtagcaagtgggaaggacagaagattttgcgacctattaacgatcctcttaagtccactggacacatccgaattctgcgcggtaatcttgcccctggaggtgctgtctctaagatcacaggcaaagaaggcttgcgctttaccggtaaatgccgggctttcgatgatgaggagggcttcgtgaaggccgtcgaaagcggttctatcaaaaagggagagaaaactgttgttgtcttgaggtaccttggccccaagggcggacctggtatgcctgaaatgctcaaacctaccagtttgatcatgggcgctggtctaggatatgatgtcgcttgtctgacagatggacgatttagcggaggttctcatggcttcgttgttggccatgtcgttccggaggcccaggttggaggacccattgctttggttcaagacggcgatgttattcatattgatgccgttgcgaacactttgtctgtggacgtatccgacgaagagatggcccgcagaaaggagaactgggttgcccctcctctcaaggtcactcacggaacattgctcaaatacgcccgagctgttaccgatgcttctcatggatgtgtcacggatgcttaa

SEQ ID NO: 464 - protein, 596 aa, Cryptococcus neoformans
MLSRRIATASPAAHTRAFHASAAKASKEVIMNRYSRTITQPKAQGASQAMLYATEGIVNDEDFNKAMVGVASVWYEGNPCNRHILGLGQRVKKSLMNAGIVGYQFGTVGVSDGISMGTSGMSYSLQSRDLIADSVETAAGGHWLDGMVVLPGCDKNMPGALIALGRLNRPSMMVYGGTIRPGSCGGEVLDIVSAFQSYGRYLQEGQTPEAEKTRYNTIRNACPGPGACGGMYTANTIASASEALGMTLPGSSSFPAEYPEKHAECDAVGETMRKVLEDNLLPRQIMTRQAFENAMALTMALGGSTNVVLHLIAIARSVGINLTIDDFQTVSDRVPLLADLKPSGKYVMEDINTIGGTPSVIHYLIKNGIMTGDEMTITGKTLGENCDRWVEEHGSKWEGQKILRPINDPLKSTGHIRILRGNLAPGGAVSKITGKEGLRFTGKCRAFDDEEGFVKAVESGSIKKGEKTVVVLRYLGPKGGPGMPEMLKPTSLIMGAGLGYDVACLTDGRFSGGSHGFVVGHVVPEAQVGGPIALVQDGDVIHIDAVANTLSVDVSDEEMARRKENWVAPPLKVTHGTLLKYARAVTDASHGCVTDA

SEQ ID NO: 465 - DNA, 1833 bp, Ustilago maydis
atgctgcgatccgccctcagtccctcagcacgttgcgtcctgcgcggcggcctcgcctcccgccgcgctctccacacctcctcagccgctctcaacacagagcgcgctccgccgggcgctctaaacaagtactcgcgtatcatcacccggcccaaggatcagggagcatcgcaagccatgctctacgccaccgacggcatccagtcggacgaggacctcacgcgtgctatggttggtatcggctcgatttggtacgagggcaacccatgcaacgcgcacctgctcgccatctcgcagcgcgtcaaaaagtcggtgcagcaagccggtctcaccggttatcagtttggatctgtcggtgtttcggatggtatctcgatgggtacagacgccatgtcgtactcgctcccgtcgcgtgatctgatcgctgactcggtggaatcggcttgcggtggtcattggcttgatggctgtgtggtgattcccggttgcgacaagaacatgcctggtgtgctgatggctctcggccgtctgaatcgtcccggaatcatgctctacggcggaacgatccgtcccggtggatgtgctagcgtcgagggcacgctcgacattgtctctgctttccagtcgtacggccagtacctcgccaacggaggctctccggctgctgaaaagattcgctatgacaccgtccgcaacgcctgtcccggtcccggtgcgtgcggtggcatgtacaccgccaacaccatggcttcatgcgccgaggctctcggcatgacgctcccaggtagctcgtcgttcccggcagaataccctgaaaagatcgccgaagccgaaaatatgggagccgccatgcgcctcgtcctcgaaaaggacatcaagccgcgcgacatcatgacgcgatccgccttcgaagatgcgatcgctctcaccatggttctcggaggcagcacgaatgcagtcttacatctgattgctgtcgctcactcggtcggcatcgagctcagcattgacgacttccagcgcatcgccgacgtgactccattccttgccgacctcaagccgtcgggcaagtacgtgatggaagatgttcactcgaaactcggcggtatcccgacgattattcagtactgcatcgagaacaagctgatgaagggtgaacacatgaccgtcaccggtcgaacgcttgccgagaacgtcgaccgatggacgcacgagcgcggcaaactgcctgcaggccaagacgtgctccgaccgatcgacaagcctctcaagagcaccggccacattcgaatcctcaagggcaatcttgcgcctggtggcgccgtcgccaagatcactggaaaagagggtctgcgattcacaggtaaagcgcgcgtctttgacaccgaagatgccatggttggcgccgttgaaaagggcgagatcaagaagggtgaaaagacagtgatcgtgttgcgctacaagggtcctaagggtggacctggtatgcccgagatgctcaaacctaccagtttgatcatgggcgctggtcttgggcaggatgtagcctgtttgaccgacggtcggttctccggtggaagtcacggtttcgtcatcggtcacgtcgttcccgaggcacaggtcggaggtccgatcggcctcgtaaaggatggtgatgtgatcagcatcgatgccgagaccaacacgttggagcttgtcggtgtatccgctgccgatctcgagtcccgaagagagtcgtggaagcctctaccgctcaaaccgaaatcgggccacctgctcaagttcgttcgtaacgttgccgatgcttcgcatggttgcatcaccgatatgtga

SEQ ID NO: 466 - protein, 610 aa, Ustilago maydis
MLRSALSPSARCVLRGGLASRRALHTSSAALNTERAPPGALNKYSRIITRPKDQGASQAMLYATDGIQSDEDLTRAMVGIGSIWYEGNPCNAHLLAISQRVKKSVQQAGLTGYQFGSVGVSDGISMGTDAMSYSLPSRDLIADSVESACGGHWLDGCVVIPGCDKNMPGVLMALGRLNRPGIMLYGGTIRPGGCASVEGTLDIVSAFQSYGQYLANGGSPAAEKIRYDTVRNACPGPGACGGMYTANTMASCAEALGMTLPGSSSFPAEYPEKIAEAENMGAAMRLVLEKDIKPRDIMTRSAFEDAIALTMVLGGSTNAVLHLIAVAHSVGIELSIDDFQRIADVTPFLADLKPSGKYVMEDVHSKLGGIPTIIQYCIENKLMKGEHMTVTGRTLAENVDRWTHERGKLPAGQDVLRPIDKPLKSTGHIRILKGNLAPGGAVAKITGKEGLRFTGKARVFDTEDAMVGAVEKGEIKKGEKTVIVLRYKGPKGGPGMPEMLKPTSLIMGAGLGQDVACLTDGRFSGGSHGFVIGHVVPEAQVGGPIGLVKDGDVISIDAETNTLELVGVSAADLESRRESWKPLPLKPKSGHLLKFVRNVADASHGCITDM

SEQ ID NO: 467 - DNA, 1770 bp, Malassezia globosa
atgtcgacgacatgtgcttgcaccacagcaaagaaggatcgcccagcaccaggtgatctgaatcggtactcgcgcttgataacgcaaccaaaagatcagggtgcatcacaggcaatgttgtatgccacgcacggaatccagtcagatgaggatttacgacgtgccatggttggcgtggccagtgtctggtacgaaggcaacccatgcaacgcgcacttgctgggcgttggacagcgaattcgagattctctcgacagggccggcctgacaggctaccaatttggcacagtcggcgtgtctgacggtattagcatgggaaccagtgccatgtcgtactcgcttccgagtcgggatctcattgccgacagcgttgaaagctgcatgggtggccattggcttgatggatgtgttgtggtgccagggtgtgacaagaacatgccgggtgtgctcatggcacttggccgtctgaatcgtccaggcattatggtatatggtggcacgattcgccctggccactgcggatcgatcacaggtacacttgacattgtgagcgcgttccagagttacggacagtacctggcatcaggcggcacgcccgatgccgaaaagatccgctacgacactgtacgtcatgcgtgcccaggaccaggtgcttgcggtggtatgtacacggccaataccatggcatcatgtgcagaggtgctgggtatgacactacccggcagtagctctttccctgccgaatacaacgagaagaaggccgaatgtgacagtattgggccaacgatgcgcatgctgcttgagaagaacattcgcccgcgagatattatgacgcgcagcgcattcgaagatgcaatggtacttacgatggtgctgggtgggtcgacgaatgctgtattgcacctgctcgccatggcccgaagcgtgggcgtagacctatctatcgatgacttccaacgcgtgagtgattcaactccgttccttgccaatctgaagccaagtggccagtacgtcatggaagacgtacacaccgtactgggcggcattccttccgttgtacactacttgattgagaacaaactcatgaaaggtgagcacatgactgtaacgggtcgaacactgcgtgaaaactgtgagcaatgggttgcagagcgcggtcccatgcccaaggaccaagatgttctccgccccatcgacaagccgatcaagcgtacaggccacatccgtgttctttacggcaacctagctcccggtggtgctattgccaagatcacaggcaaggaaggtctcgaatttacagggaaagcacgcgtatttgacacggaagatgacatggtgcatgctgtcgagcaagggacgatcaaaaagggcgagaagactgtggtgatacttcgctacaaaggtcccaagggcggtccagggatgcctgaaatgctcaagccaacgagtttgatcatgggcgcaggtctcggtcacgacgttgcttgcctcacagacggccgctttagcggcggttcgcacggcttcgtgattggacatgtcgttcccgaagcacaagagggtgggccgattgcccttgtgcgggatggcgatgaaatcactatcgatgcggtgaacaactcgatccagatcaacaatgtctcagacgaggagctcgcgcagcgccgcgccgcttggcaaccccggcctcttacagtcaaccagggcggcttgtataaatacacgcgactcgtatcaaacgcaagtcagggctgtgtgacagatgcatga

SEQ ID NO: 468 - protein, 589 aa, Malassezia globosa
MSTTCACTTAKKDRPAPGDLNRYSRLITQPKDQGASQAMLYATHGIQSDEDLRRAMVGVASVWYEGNPCNAHLLGVGQRIRDSLDRAGLTGYQFGTVGVSDGISMGTSAMSYSLPSRDLIADSVESCMGGHWLDGCVVVPGCDKNMPGVLMALGRLNRPGIMVYGGTIRPGHCGSITGTLDIVSAFQSYGQYLASGGTPDAEKIRYDTVRHACPGPGACGGMYTANTMASCAEVLGMTLPGSSSFPAEYNEKKAECDSIGPTMRMLLEKNIRPRDIMTRSAFEDAMVLTMVLGGSTNAVLHLLAMARSVGVDLSIDDFQRVSDSTPFLANLKPSGQYVMEDVHTVLGGIPSVVHYLIENKLMKGEHMTVTGRTLRENCEQWVAERGPMPKDQDVLRPIDKPIKRTGHIRVLYGNLAPGGAIAKITGKEGLEFTGKARVFDTEDDMVHAVEQGTIKKGEKTVVILRYKGPKGGPGMPEMLKPTSLIMGAGLGHDVACLTDGRFSGGSHGFVIGHVVPEAQEGGPIALVRDGDEITIDAVNNSIQINNVSDEELAQRRAAWQPRPLTVNQGGLYKYTRLVSNASQGCVTDA

SEQ ID NO: 469 - DNA, 1824 bp, Aspergillus clavatus
atggatgcctccaaccccgcgctgtccagcacatccgaagcaaaatatatcaacttccccagtcttcccgatgacgcaaaacacgacgacggcacgcttgcgctgaatagatactcgtcctatatcactcgcggccatgacttccctggtgcccgggcaatgctgttcgcggcgggtatcccagatcgcgatgccatgacaaagagcccccaggttggtgttgccagtgtctggtgggagggaaacccgtgcaacatgcacctgttggatttgggcaagacggtcaagaaagccgtcacggagcagggcatgatcggatggcagtataacacgattggggtttcggatgggattacgatgggtagtgatgggatgcgattttctctgcagacgcgcgagatcatcgccgatagtgtcgagacagtgacatgtgcgcagtaccatgatgcctgtattgccatccctggatgtgacaagaacatgcctggcgtggtgatgggcatggcacggcacaatcggccgtcgatcatgatctacggtggcacgattcagatcggctattccaatctcctgcggaagcctatcaacgtgtcgtcttgtttcgaggccgcgggcgcatatgcatacgacactttgcgccaaccggacgacggaggcgataccagcaagaccaaggatgagatcatggatgacctggagagacacgcgtgccccacggcaggcgcctgcggaggcatgttcacggcaaacacgatggccacggcgatcgagtcgatggggctgtctctgcccggatcatcgtcgacacctgcgtcgtcgccatcgaagatgcgggagtgcgtcaaggcggctgaagccatcaaggtctgcatggagaagaacatcaagccccgagatctgttgaccaagcggtcatttgagaacgccctggttatgaccatggcgctgggcggaagcaccaatggtgtcttgcatttcctcgccatggccaggacggccgaggtggatctcaccttggatgatatccagcgagtgagcaataagatccccttcatcgcggatctggctccgagcgggaagtactacatggcggacctgtatgatatcggaggcattccgtctgtgcagaagctgctgatcgcagcgggtctcctcgacggcgatatccccacagtcactggcaagacgttggccgagaacgttgcctccttcccatcgctgcctcaagatcaagtcatcattcgccctctcgataagcccatcaaggcgactgggcacctgcagatcttgcgcggaaacctggcacctggaggagcagtcgccaagatcaccggaaaggagggaaccaaattcacaggcaaagcccgtgtctttaataaggagcatcaattgaacgatgctgtgacccagggcaaaattcctcgtggcgagaacctggtgcttattgtccgttacgaaggccccaagggcggaccgggtatgccggaacagctcaaagccagtgcagcgctcatgggagccaagctcaacaacgtggcgctgatcacagatgggcgatactcaggagccagtcacgggttcatcgtcggccatattgtccccgaagctgcagttggcggaccgattgctgttgtccgtgacggcgatgtgattaccatcgatgcggagaccaacaccatcagcatggatgtttcggacgaggagattcgacagcgtctgaaggaatggaagcccccaacgccccatgtcacacgtggcgtactagccaagtatgccaggctggttggagatgcctctcatggcgcgatgacggatctattctag

SEQ ID NO: 470 - protein, 607 aa, Aspergillus clavatus
MDASNPALSSTSEAKYINFPSLPDDAKHDDGTLALNRYSSYITRGHDFPGARAMLFAAGIPDRDAMTKSPQVGVASVWWEGNPCNMHLLDLGKTVKKAVTEQGMIGWQYNTIGVSDGITMGSDGMRFSLQTREIIADSVETVTCAQYHDACIAIPGCDKNMPGVVMGMARHNRPSIMIYGGTIQIGYSNLLRKPINVSSCFEAAGAYAYDTLRQPDDGGDTSKTKDEIMDDLERHACPTAGACGGMFTANTMATAIESMGLSLPGSSSTPASSPSKMRECVKAAEAIKVCMEKNIKPRDLLTKRSFENALVMTMALGGSTNGVLHFLAMARTAEVDLTLDDIQRVSNKIPFIADLAPSGKYYMADLYDIGGIPSVQKLLIAAGLLDGDIPTVTGKTLAENVASFPSLPQDQVIIRPLDKPIKATGHLQILRGNLAPGGAVAKITGKEGTKFTGKARVFNKEHQLNDAVTQGKIPRGENLVLIVRYEGPKGGPGMPEQLKASAALMGAKLNNVALITDGRYSGASHGFIVGHIVPEAAVGGPIAVVRDGDVITIDAETNTISMDVSDEEIRQRLKEWKPPTPHVTRGVLAKYARLVGDASHGAMTDLF

SEQ ID NO: 471 - DNA, 1827 bp, Neosartorya fischeri
atggactcctctacctccacgtcgtccaacacccagggcgaagccaagtatatcaacttccccagtcttcctgacgacgcaaagcatgaagatggcacccctgcgctgaacagatattcttcttatatcactcggagccatgactttcctggtgctcgggctatgctttttgcagcgggaattccggatcgcgaagcgatggctaagagtccacaggtgggaattgccagtgtctggtgggagggaaatccttgcaatatgcacctgctggacttgggcaagacggtgaagaaggccgttacggatcagggcatgaccggttggcagtataataccattggagtttcagatgccatttcaatgggtagtgagggcatgagattttctctccagtcgcgtgagatcattgcagacagcgtcgagaccgtgacttgtgcgcagtatcatgatgcatgcattgctattcctgggtgcgacaagaatatgcctggagtggtgatgggtatggcgagacacaatcggccttcgcttatgatttacggtggaacaattcaaattggatactcgaacctgctgcgaaagcgggtcaacgtgtcaacttgctttgaagcggctggtgcctatgcctacgatactttgcgtcaaccggacgatgggggtgacaccagtaaaagcaaggacgagattatggatgacattgagagacatgcttgtcccagtgcgggcgcatgtggaggcatgtttactgcaaacacaatggccacggcgattgagtccatgggcctgtccctaccagggtcatcatcaacgcctgcctcgtctccatcgaagatgcgagaatgtgttaaagcggcagaagccatcaagatctgtatggagaagaacattaagcctcgggatcttttgaccaagcgctccttcgagaacgccctcgtcatgacgatggctctgggaggaagtaccaatggtgtcttgcacttccttgccatggctcggacggcggatgtgaacctgaccctagatgatatacaacgggtcagcaacaagatcccattcattgctgacttggcccccagtgggaagtactacatggcagacctgtacgatattggagggatcccgtctgtgcagaagttgctgatcgcagcgggccttcttgacggcgacatccccacggtcaccggcaagaccttggctgagaatgttgcatctttcccatctctacctcaggaccaagtcatcatccgccccctggacaacccaatcaagacgactggccacctgcagattctacgtggaaacctggcgcctggtggagcggtggccaagatcactggcaaggagggcaccaagttcacaggcaaagcacgtgttttcaataaagaatttcagctcaacgatgctctgacccaaggcaagattcctcgaggcgaaaacctggtgctcatcgtccgctacgaaggacccaagggtggaccaggcatgccggagcagctcaaagcgagtgcggcgctgatgggagctaagctcaacaatgtggccctaatcacagatggaagatattcaggggctagtcatggattcatcgtgggtcatatcgtcccagaagctgcggccggaggacccattgccattgttcgcgatgatgatgtgattaccatcgatgcggaaaccaacacaataaacatgcatgtctcagatgaggaaatccagcagcgactgaaagagtggaagcccccagtgcctcatgtcacacgtggtgtactcgccaagtatgcaaggctggttggggacgcctctcatggtgcaatgacggatctgttctag

SEQ ID NO: 472 - protein, 608 aa, Neosartorya fischeri
MDSSTSTSSNTQGEAKYINFPSLPDDAKHEDGTPALNRYSSYITRSHDFPGARAMLFAAGIPDREAMAKSPQVGIASVWWEGNPCNMHLLDLGKTVKKAVTDQGMTGWQYNTIGVSDAISMGSEGMRFSLQSREIIADSVETVTCAQYHDACIAIPGCDKNMPGVVMGMARHNRPSLMIYGGTIQIGYSNLLRKRVNVSTCFEAAGAYAYDTLRQPDDGGDTSKSKDEIMDDIERHACPSAGACGGMFTANTMATAIESMGLSLPGSSSTPASSPSKMRECVKAAEAIKICMEKNIKPRDLLTKRSFENALVMTMALGGSTNGVLHFLAMARTADVNLTLDDIQRVSNKIPFIADLAPSGKYYMADLYDIGGIPSVQKLLIAAGLLDGDIPTVTGKTLAENVASFPSLPQDQVIIRPLDNPIKTTGHLQILRGNLAPGGAVAKITGKEGTKFTGKARVFNKEFQLNDALTQGKIPRGENLVLIVRYEGPKGGPGMPEQLKASAALMGAKLNNVALITDGRYSGASHGFIVGHIVPEAAAGGPIAIVRDDDVITIDAETNTINMHVSDEEIQQRLKEWKPPVPHVTRGVLAKYARLVGDASHGAMTDLF

SEQ ID NO: 473 - DNA, 1827 bp, Aspergillus oryzae
atggatccctccaaccccgccgtctccgcaacctttggggaagcgaaatacatcgaattcccctgtcttccagaggggacgaagcatgaggatggaacacctgcactgaatcgctactctgcaaccatcactagaggccatgacttccctggcgctaaggcaatgctctatgcagcaggtgttcccgaccaaaacgctatggcaaagagtcctcaggtaggagttgcatctgtgtggtgggaaggaaatccgtgtaacatgcacctgctggatatgggcaagacggtaaagaaggccgtcgagggccagggcatgattggttggcaatataacaccattggtgtttcagatgccatcaccatgggcagtgaaggcatgcggttttctctccaaacgcgtgagatcattgcagatagtgtcgagactgtgacttgtgctcagtaccacgatgcctgcattgccatccccggatgcgacaagaacatgcctggagtggtgatgggtatggccaggcataaccggccctccatcatgatctacggcgggactattcagattgggtattccaacctcctacgaaagccaattaacgtttcgagttgcttcgaagccgctggggcttactcatatgatactttgcgtcaaccggacgacggtggagacaccagcaagaccaaggatgagatcatggatgatcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccggcaaggagggcactaaatttataggaaaggcacgagtgtttgataaggagtatcaactcaatgatgcactcaaccagggtaaaataccccgagatgagaatttagtgatcatcgtccgttatgagggccccaagggcggaccgggaatgccggaacagctcaaggccagcgcggcattgatgggagccaagcttaccaacgtggcactgatcactgatggaagatactcaggggcaagtcatgggttcatcgtcggccatatcgtacccgaagccgcggtaggaggaccaatcgctgttgtccgcgatggggacgtggtcacaattaatgcggaaaccaacgaaattagcatggatgtctcggatgaagaaatccagcaacggctgagagagtggcaacctcccgcaccgcacgttacacgcggtgtgctggccaagtatgctcggctggttggtgacgcttcccacggcgcaatgacggaccttttctag

SEQ ID NO: 474 - protein, 608 aa, Aspergillus oryzae
MDPSNPAVSATFGEAKYIEFPCLPEGTKHEDGTPALNRYSATITRGHDFPGAKAMLYAAGVPDQNAMAKSPQVGVASVWWEGNPCNMHLLDMGKTVKKAVEGQGMIGWQYNTIGVSDAITMGSEGMRFSLQTREIIADSVETVTCAQYHDACIAIPGCDKNMPGVVMGMARHNRPSIMIYGGTIQIGYSNLLRKPINVSSCFEAAGAYSYDTLRQPDDGGDTSKTKDEIMDDLERHACPSAGACGGMFTANTMATAIESMGLSLPGSSSTPATSPSKMRECVKVAEAIKVCMEKNIRPRDLLTKRSFENALVMTMALGGSTNGVLHFLAMARTAGVELTLDDIQRVSNKIPFIADLSPSGKYYMADLYDIGGVPSVQKLLIAGGLLDGDIPTVTGKTLAENVASFPSLPDDQVIIRPLDNPIKATGHLQILRGNLAPGGAVAKITGKEGTKFIGKARVFDKEYQLNDALNQGKIPRDENLVIIVRYEGPKGGPGMPEQLKASAALMGAKLTNVALITDGRYSGASHGFIVGHIVPEAAVGGPIAVVRDGDVVTINAETNEISMDVSDEEIQQRLREWQPPAPHVTRGVLAKYARLVGDASHGAMTDLF

SEQ ID NO: 475 - DNA, 1827 bp, Aspergillus niger
atggaccccgccaaacctgccgtgtcatccactttgggggaggccaagtaccttgaatttccctgcgtaccagagggcacaaaacacgaagatggtacccccgtcttgaaccgttggtcttctactatcaccaggggccatgagttccctggcgcgaaggctatgctctacgcggcaggcatccccgatcacaatgccatgacgaagagtccccaggttggtgttgcgtctgtgtggtgggaaggcaacccttgcaacatgcacttgttggacctggccaagacggtgaagaaggcgatcacggaccaaggcatgatcgggtggcagtacaatactattggtgtgtcggatgcgattggcatggggagtgaaggtatgcgattttctctccaaacccgtgagatcattgcagacagtgtggagtctgtaacgtgcgctcaataccatgacgcctgcattgccatccccggatgcgacaagaacatgcctggtgtggtgatgggtatggcgagacacaatcggccctcgatcatgctctacggtggtactatcgaggttgggtattcccagcttcttcggaagcgggtaagcgtttcgacgtgcttcgaagcggctggtgcctacacatataacactctccgtcagccggatgacggaggtgataccagcaagaccaaggacgagatcatggatgatctggagaggcatgcctgcccgagcgcgggagcgtgtggtggtatgttcacggccaacaccatggctacggccattgagtccatgggtctctccttgcccggctcgtcttctacgcctgcatcttccccaactaagatgcgtgagtgtgtcaaggcagctgaagccatcaagatttgcatggagaagaacatccgtcctcgggatctgttgaccaagcgggcgttcgagaatgccctggtcatgactatggccctgggaggtagcaccaatggtgtgcttcacttcctggctatggcccgcactgccggcgtggaccttactctggacgacgttcagcgggtcagcaacaagatccctttcattgcggacctgtcccctagtgggaaatactacatggcggacctctacgaagtcggaggcatcccgtcggttcagaagttgttgatcgcagctggtctgctcgacggcgatatccccaccgtgaccggcaaaactctggcccagaacgtcgcatcgcacccatctctgtctgctgaccaggtcatcatccgtcccctggataaccctatcaaggcgacgggccacctccagatcctgcgaggtaaccttgcacccggtggtgcggttgctaagattaccggcaaggaagggctccggttcacgggtaaggcgcgcgtgtttgacaaggagcatcagctcaacgaggccctgaaccagggcaagatccctcacggcgagaacctggttatcgtagttcgttacgagggcccgaagggtggcccgggaatgccggaacaactgaaggccagtgcagcgctcatgggagccaagctcaccaacgtggcactgattacggacgggcggtactctggcgctagtcacggattcattgtggggcatattgtccctgaagctgctgtaggaggacccattgccgttgttcgggacggcgatgtgatcacaattgatgccgaatcgaacgccatcaccatggatgtatcggatgaggaggtgcagcagcgtctgcgggagtggaagcccccggcaccgcatgtcacacgaggtgtgctggccaaatatgcccggttggtgggagatgcctcgaacggagccatgacggatctattttag

SEQ ID NO: 476 - protein, 608 aa, Aspergillus niger
MDPAKPAVSSTLGEAKYLEFPCVPEGTKHEDGTPVLNRWSSTITRGHEFPGAKAMLYAAGIPDHNAMTKSPQVGVASVWWEGNPCNMHLLDLAKTVKKAITDQGMIGWQYNTIGVSDAIGMGSEGMRFSLQTREIIADSVESVTCAQYHDACIAIPGCDKNMPGVVMGMARHNRPSIMLYGGTIEVGYSQLLRKRVSVSTCFEAAGAYTYNTLRQPDDGGDTSKTKDEIMDDLERHACPSAGACGGMFTANTMATAIESMGLSLPGSSSTPASSPTKMRECVKAAEAIKICMEKNIRPRDLLTKRAFENALVMTMALGGSTNGVLHFLAMARTAGVDLTLDDVQRVSNKIPFIADLSPSGKYYMADLYEVGGIPSVQKLLIAAGLLDGDIPTVTGKTLAQNVASHPSLSADQVIIRPLDNPIKATGHLQILRGNLAPGGAVAKITGKEGLRFTGKARVFDKEHQLNEALNQGKIPHGENLVIVVRYEGPKGGPGMPEQLKASAALMGAKLTNVALITDGRYSGASHGFIVGHIVPEAAVGGPIAVVRDGDVITIDAESNAITMDVSDEEVQQRLREWKPPAPHVTRGVLAKYARLVGDASNGAMTDLF

SEQ ID NO: 477 - DNA, 1773 bp, Aspergillus terreus
atggacccctcgactcccgccgtgtcgtccaccatgggcgaggccaaatacatcgaatttcccagtctccccgacgacgcaaaacaccccgatggcacccccgcgctgaaccgctactcaacaaccatcacgagaggccatgactttcccggtgcgaaggccatgctgtatgcggccggcatcccggaccaggaaaccatggccaaagcgccgcacgtcggaatcgcctcggtctggtgggaggggaacccgtgcaacatgcacctgttagatctgggaaagacggtgaagaagtcggtggacgcacagggcatgatcggatggcagtacaacaccattggtgtgtcggacgccattaccatgggcagcgagggaatgcgcttctcgctgcagtcccgcgagatcatcgcggacagcgtcgagacagtcacctgcgcgcagtaccacgacgcgtgcatcgccatccccggctgcgacaagaacatgccgggcgtggtgatgggcatggcgcggcacaatcggccgtcgatcatgatctacggcggcacgatccagatcggctactccaacctgctacgcaagccgatcaacgtgtcgacgtgctttgaggcggcgggcgcctatgcctacgacacgctgcggcagccggacgacggcggcgacacgagcaagaccaaggacgagatcatggacgagctggagcagcacgcgtgcccgagcgcgggcgcgtgcggcggcatgttcacggccaacacgatggcgacggcgatcgagtcgatggggctgtcgctgcccgggtcgtcgtcgacgccggcgtcgtcgccggccaagatgcgcgagtgcgccaaggccgccgacgccatcaagcggtgtctggcgctgaacctccggccgcgcgacctgctcaccaagcgcgcggggcgcccccccgggggtggccccccccctttgagggacatcccagggggtgaggcgaccgcattcccttcattggccaccttttggcccaaggggcaaagttactccatgggcagatctgttcggagattcgggggcgtgcggtccgtgcaggaggttgtttattcgcagccggcctgcttgacggcgccatccccacggtcacgggcaagacccctcgccggagaacgtggcctcggtggccgtccctgcccgccgacccaggtcatcatccgcccgctcgacaaccccatcaagccgacgagccatctgcagattctgcgcggcaacctggcccccggcggcgccgtcgccaagatcaccggcaaggagggcacgcgcttctcgggcaaggccctcgtcttcgacaaggagtaccagctcaacgacgccctgaaccagggccagattccccgcggcgagaacatcgtcatcgtcgtccgctacgagggccccaagggcgggcccggcatgcccgagcaactcaaggcgagcgccgccctgatgggtgcgaagctcaccaatgtggccctgatcaccgatggtcggtactcgggcgcgagccatggcttcatcgtcggccatattgtccccgaggccgcggtgggtggccccattgcggtcgtccgcagcggtgatgtgatcacgattaatgcggaaaccaacgagatcaccatggatgtctcggacgaagagatccagcagcgtctgaaggagtggaagcccccagcacctcatgtcacgcggggcgtgttggccaagtatgcccggttggtgggagatgcttcgcacggtgccatgaccgacctgttttag

SEQ ID NO: 478 - protein, 590 aa, Aspergillus terreus
MDPSTPAVSSTMGEAKYIEFPSLPDDAKHPDGTPALNRYSTTITRGHDFPGAKAMLYAAGIPDQETMAKAPHVGIASVWWEGNPCNMHLLDLGKTVKKSVDAQGMIGWQYNTIGVSDAITMGSEGMRFSLQSREIIADSVETVTCAQYHDACIAIPGCDKNMPGVVMGMARHNRPSIMIYGGTIQIGYSNLLRKPINVSTCFEAAGAYAYDTLRQPDDGGDTSKTKDEIMDELEQHACPSAGACGGMFTANTMATAIESMGLSLPGSSSTPASSPAKMRECAKAADAIKRCLALNLRPRDLLTKRAGRPPGGGPPPLRDIPGGEATAFPSLATFWPKGQSYSMGRSVRRFGGVRSVQEVVYSQPACLTAPSPRSRARPLAGERGLGGRPCPPTQVIIRPLDNPIKPTSHLQILRGNLAPGGAVAKITGKEGTRFSGKALVFDKEYQLNDALNQGQIPRGENIVIVVRYEGPKGGPGMPEQLKASAALMGAKLTNVALITDGRYSGASHGFIVGHIVPEAAVGGPIAVVRSGDVITINAETNEITMDVSDEEIQQRLKEWKPPAPHVTRGVLAKYARLVGDASHGAMTDLF

SEQ ID NO: 479 - DNA, 1827 bp, Coccidioides immitis
atggcttctcaagctcctattgcgcaagatggaccaaacgaggaggcgaaatatatcgacttcccctgtcttcctgatgatgcgatgcgggacggaaaaccggccttgaacaaatattctcagttcattacaaaaggtcatgattacccaggtgcccaggcaatgttatatgctgctggggtacctgatagggatgccatgaaaacgagtcctcatgttggcattgcatcagtatggtgggaaggaaatccctgcaacatgcacttgttggatttaggaaagactgtgaaaaaggctgttatagatcagggcatgctgggatggcaatacaataccattggtgtctctgacgcaatcacaatgggtcatgaaggcatgcgcttttctctgcagtctcgtgagatcattgccgacagcatcgaaactgtgacttgcgcacaataccatgacggttgcattgccatacctggttgtgacaagaacatgcctgggtgtattatggccatgggaagacacaaccgcccctccctgatgatatacggtggtacaattcaaggcggatattcgaaactattgcgacgacccattaacgtttcgacctgctatgaggccgcgggtgcttatgcgtataatactttagtccagccggacgatgggggggacaggagcaaaactaaggatgagatcatggaagacattgaaagacatgcttgtccgagcgctggggcttgcgcaggcatgtatactgcgaacacaatggccacagcaattgagtcgatgggtctgactctgcctggttcatcttctacccccgcaacatcaccagcgaagatgcgagaatgtgtaaaagcggctgatgcaattaaattgtgcatggagaggaacatcagaccgcgcgacttattgacaaaacggtcctttgagaatgccctggtcatgacaatggctctcggtggaagcactaacggcgttgttcatttcattgccatggctagatcggctggtgttcacttaatgctagatgacatccagcgtgttagtgacaaaattccttttatcgcgaacctcgccccaagcggaaaatattacatggcagatctatacgaaattggaggcattccatccgtccagaaattgcttgtcgccgcaggccttttagatggcggtattcccacggtgactggaaagacattggcggagaacattgcatctttcccctccctcccacaagaccaagctatcattcacccacttgacaacccgatcaagtcaaccggccatctccaggtgctcaggggaaaccttgcccctggcggtgctgtcgctaaaattaccggaaaagaaggtactaaatttacgggaaaggctcgcgtatttaacaaagagcacgagttggacgccgctctaagccgtggcgagattccacgcggagataacctcgtcctcgtcgttcgatatgagggaccaaagggtggtcccggaatgccggaacaactcaaagctagtgctgccttgatgggagctaaactcacaaacgtagcgctgattacagatggcagatattcaggtgccagtcatggatttattgttggacacattgtcccagaagctgcagtgggcggtccgattgctgttgtgcaggatggtgatacgatcacaatcaacgcggataccaacgaactcacaatggatgtttctgacgaagaaatcgcacagcgtttgaaggggtggaaaccgccaaaaccacgtgttacccggggggtgctggcgaagtatgctaaattagtcggagatgcatcaaatggtgctatgactgaccagttttag

SEQ ID NO: 480 - protein, 608 aa, Coccidioides immitis
MASQAPIAQDGPNEEAKYIDFPCLPDDAMRDGKPALNKYSQFITKGHDYPGAQAMLYAAGVPDRDAMKTSPHVGIASVWWEGNPCNMHLLDLGKTVKKAVIDQGMLGWQYNTIGVSDAITMGHEGMRFSLQSREIIADSIETVTCAQYHDGCIAIPGCDKNMPGCIMAMGRHNRPSLMIYGGTIQGGYSKLLRRPINVSTCYEAAGAYAYNTLVQPDDGGDRSKTKDEIMEDIERHACPSAGACAGMYTANTMATAIESMGLTLPGSSSTPATSPAKMRECVKAADAIKLCMERNIRPRDLLTKRSFENALVMTMALGGSTNGVVHFIAMARSAGVHLMLDDIQRVSDKIPFIANLAPSGKYYMADLYEIGGIPSVQKLLVAAGLLDGGIPTVTGKTLAENIASFPSLPQDQAIIHPLDNPIKSTGHLQVLRGNLAPGGAVAKITGKEGTKFTGKARVFNKEHELDAALSRGEIPRGDNLVLVVRYEGPKGGPGMPEQLKASAALMGAKLTNVALITDGRYSGASHGFIVGHIVPEAAVGGPIAVVQDGDTITINADTNELTMDVSDEEIAQRLKGWKPPKPRVTRGVLAKYAKLVGDASNGAMTDQF

SEQ ID NO: 481 - DNA, 1788 bp, Paracoccidioides brasiliensis
atgaatcccgaagagaaggtcgatggcttcgaagagccgcgatacatccagttcccttgcctgccggacgatgcgactcgggatggaaagccggtgttgaataaatattctacatttcttacagcgatgttatatggcgcgggggtgccggatcgtgagagcatgaaaaatagcccccaggtcggcattgcgacggtatggtgggaagggaatgcctgtaatatgcaccttttggatctggggaagacggtcaaaaaagccatcacggatcaggggatgctgggctggcaatataacaccatcggtgtctccgatgctatttccatgggtagtgaaggtatgcgatactccctccaatctcgggagatcattgcagacagcatcgagacagtagtaggtgctcaatatcatgatgctgcattgcgattccgttgcgacaagaacatgccaggctgcgtcatgggtatggccagacataacagaccgtctttgatgatatacggtgggacaattcaggtcgggtactccaagttactccgcaggcgaatcaacgtctctacttgctacgaagcagctggcgcgtacgcttacaacaccttaacccagcccgacgacggcggagaccgctcgaggacgaaagatgaaatcatggaagacattgagcgaaatgcctgtcccagcgctggcgcatgcgcgggaatgtacacagcaaacaccctggctaccgcgattgagtcaatgggtttgactctgccaggctcctcgtccaccccagctacggtgcctgccaagatgcgcgagtgcgtaaaagcagcggacgcgatcagaatatgtatggagaagaacattaggccgcgagatctacttacgaaacgctcctttgagaatgcgctggtaataaccatggcgctgggcgggagcacgaacagcatcgttcacctgatagcgatggccagaacggcccgggttgaattaacactcgatgattcccagcgtgtgagcgacaaaatcccgtttattgttgacttggcacccagtgggaaatactacatggcagacctttatgaaattggcgggattccatctgtgcagaagctgttgattgccgcaggcttgatggacggtgacatccccacagtaactggcaaaacgctagcagagaacatccaatccttcccctccctcccacaggaccaggccatcatccacccgctagccaaccccatcaagagcacgggccatatacaaatattgaaaggcaacctcgcccccggcggcgccgtagccaaaatcacaggcaaagaaggcaccaaattcaccggcaaagccctcgttttcaacaaagaacacgagcttgacgaagcgcttaacaagggcctaataccccgcggcgaaaacctagtgctaatagttcgctacgagggtccgaagggtggccccggcatgcccgagcagctgaaggccagcgcagcgctgatgggcgccaaactgacgaatgtcgcgctaattacggacgggaggtattcgggggccagtcatgggtttattgtcgggcatattgtgcctgaggcggcggttggggggcccattgctgttgtgcacaatggggatatgattacgattgatgcggagagaaatgagattagtatggcggtttcggaggaggaggttgcggagaggttgaaggagtggaggccgccgaagccgcatgtgactagggggacgttggccaagtatgcgagacttgttggagacgcgtcgcatggggctatgacggatatgttttga

SEQ ID NO: 482 - protein, 595 aa, Paracoccidioides brasiliensis
MNPEEKVDGFEEPRYIQFPCLPDDATRDGKPVLNKYSTFLTAMLYGAGVPDRESMKNSPQVGIATVWWEGNACNMHLLDLGKTVKKAITDQGMLGWQYNTIGVSDAISMGSEGMRYSLQSREIIADSIETVVGAQYHDAALRFRCDKNMPGCVMGMARHNRPSLMIYGGTIQVGYSKLLRRRINVSTCYEAAGAYAYNTLTQPDDGGDRSRTKDEIMEDIERNACPSAGACAGMYTANTLATAIESMGLTLPGSSSTPATVPAKMRECVKAADAIRICMEKNIRPRDLLTKRSFENALVITMALGGSTNSIVHLIAMARTARVELTLDDSQRVSDKIPFIVDLAPSGKYYMADLYEIGGIPSVQKLLIAAGLMDGDIPTVTGKTLAENIQSFPSLPQDQAIIHPLANPIKSTGHIQILKGNLAPGGAVAKITGKEGTKFTGKALVFNKEHELDEALNKGLIPRGENLVLIVRYEGPKGGPGMPEQLKASAALMGAKLTNVALITDGRYSGASHGFIVGHIVPEAAVGGPIAVVHNGDMITIDAERNEISMAVSEEEVAERLKEWRPPKPHVTRGTLAKYARLVGDASHGAMTDMF

SEQ ID NO: 483 - DNA, 1635 bp, Phaeosphaeria nodorum
atggatccgcgcaaccttgaaaagcagcgagagccagaggagccgcgcttcctcacgttcccgcatctgccagaggatgccatgcgagatggcaagcctgcgttgaacaaatactcgtctactcttactgctggccataactttccgggagctcaggccatgctttatgcggctggtgttccctcgaaggaagccatgaagacacagcctcacgtaggcattgcgagtgtatggtgggaaggcaacccatgcaaaactgcagtgctcgacctgggaaaggagattaagaaaaacgtccaggctgacaatatgctggcatggcagtacaacactgtgggcgtgtcggatggtattacgatgggtggagagggcatgcgcttctctctgcagactcgcgagataatagcagacagtattgagacggtcacgtgcgcgcaacatcacgacgcgtgtattgccattcccggatgcgacaagaatatgcctggtgtcatcatggcatttgcccgtcacaaccgaccatcgataatggtatatggcggctccataatgccaggctattccgagacgctcaagaagcccatcaacatttcaacatgctacgagaaacacggtgcctatatctacaagaatctggagagtgctgaaaaggggaaattttcgccagaggaaatcatggatgacattgagcgcaatgcatgcccgggtgctggcgcatgtggcggcatgtacactgccaacactatgtccacgtccattgaggccaagatgcgcgaatgtgccaaagctgcagctgccatccgcgtctgcatggaaaagaacatcacgccccggaaactactcaccaaggcctccttcgagaatgccctcgtcatgatgatggtcctcggcggctcgaccaacgccgtcctgcacatgctcgccatggccggtacagcaggcgtccccttaacccttgacgacttccagcgcgtgtccaacaaaattcccttcctcgccgacctcgccccctctggccgctacatggctgccgacctctttgacattggcggcatgccctccgtcatgaagctcctcgtcgccgcgggcctccttgacggtagcatccccaccgttaccggcaagaccctcgcagaaaacatcgagccctacccttccttgccgcaagatcaggtcctcatccgccccctctccaaccccatcaaagccaccggccacatcgagatcctacgcggcaacctcgcgcccgccggcgccgtggcgaaaatcacggggaaagagggcttgatattccgcggtagggcgatggtatttgacaaggaacaccagcttgacaaggcgctgaatgaaggtcgtattccgcatggcgagaatatcgtcgttgtcgtgcgctacgagggaccgaagggtggcccgggtatgcccgagcaactcaaagccagcgcggcgattatgggcgcgaaactcaccaacgtcgcgctaattacggatgggcggtatagtggtgccagtcacgggtttattgtcgggcacatgtgtccagaagcggccgtgggtggccccattgctgtggttagggatggggatgttatcactattggtaagtcgtgttgcaaagtcggagagagatggtga

SEQ ID NO: 484 - protein, 544 aa, Phaeosphaeria nodorum
MDPRNLEKQREPEEPRFLTFPHLPEDAMRDGKPALNKYSSTLTAGHNFPGAQAMLYAAGVPSKEAMKTQPHVGIASVWWEGNPCKTAVLDLGKEIKKNVQADNMLAWQYNTVGVSDGITMGGEGMRFSLQTREIIADSIETVTCAQHHDACIAIPGCDKNMPGVIMAFARHNRPSIMVYGGSIMPGYSETLKKPINISTCYEKHGAYIYKNLESAEKGKFSPEEIMDDIERNACPGAGACGGMYTANTMSTSIEAKMRECAKAAAAIRVCMEKNITPRKLLTKASFENALVMMMVLGGSTNAVLHMLAMAGTAGVPLTLDDFQRVSNKIPFLADLAPSGRYMAADLFDIGGMPSVMKLLVAAGLLDGSIPTVTGKTLAENIEPYPSLPQDQVLIRPLSNPIKATGHIEILRGNLAPAGAVAKITGKEGLIFRGRAMVFDKEHQLDKALNEGRIPHGENIVVVVRYEGPKGGPGMPEQLKASAAIMGAKLTNVALITDGRYSGASHGFIVGHMCPEAAVGGPIAVVRDGDVITIGKSCCKVGERW

SEQ ID NO: 485 - DNA, 1803 bp, Gibberella zeae
atggcggaccaagtcactcacgatcccaagcagtcaagcgactacatccccttcccttgccttcctcccggcggagctctcaaccgttggtctacaaagatcacccgcgagcatgactaccccggagctcaggctatgctctacggagctggtgtcaaggaccagcacacaatgaagaacgcgccccaggttggtgttgctaccgtctggtggcaaggaaacccgtgcaatacccatctccttgatcttggccagatcgtcaagaactccatcgagaaggaaggcatgatcggctggcagttcaacaccgttggtgtatctgacgccatcaccatgggcggcgagggcatgcgcttctctcttcaaactcgagaaatcattgctgattctatcgagtccgtaacctgcgcccagcatcatgacgccaacatctccattcccggctgtgacaagaacatgcccggcacagtcatggccgccgctcgtcacaaccgccccttcatcatgatctacggcggtaccatccgcaagggccactccaacctccttgagaagcccatcaacatcagcacctgctacgaggcctcgggtgctttcaactacggtcgtctgcatgccaagacgaaccccggcgagcctggtcgcgagagctccgatgtcatggatgatatcgagaagcacgcttgtcccggcgccggagcttgtggtggcatgtatacagccaacaccatggctaccgctatcgaggccatgggccttactctgcctggttcatcatcgtaccctgccgagtctcctgagaagcgtcgtgagtgtgagcgcgctgcccaggttatccgaactaccatggagaaggaccttcgtcctcgcgatatcatgacccgtgcctctttcgagaacgctcttgtcctgaccatgattctcggtggttcaacaaacggtgttcttcacttcctcgccatggccaacaccgccgatgttcccctgaccattgacgacatccagcgtgccagtgaccgcacccccttcctcgctgatctcgcccccagtggaaagtactacatggaggatctctacaaggtcggcggtacaccctccgtcatcaagatgctcgtcgcccgtggtcttctcgacggtagcatcatgaccattaccggcaagactctcgccgagaacgtcgcggactggcctagtctggaccccggccaggacatcatccgtcctcttgagaaccccatcaaggactctggccacatccgcatcctaaagggtaactttgcccccggcggcgccgtcgctaagatcactggaaaggagggtctgtccttcaccggcaaggcccgtgtcttcaacaccgagaaggagctcaacggcgcactgaaccgaagcgagatcaagcagtccgatggtaacctcgtcgtcatcgtccgatacgagggccccaagggcggtcccggtatgcctgaacagctcaaggcttctgcagccatcatgggtgccggcctctccaacctggcacttgtcaccgacggacgatacagtggtgcttctcacggtttcatcgtgggccacgttgtgcctgaggctatggtcggaggtcccatcgctctggtcaaggatggagacgagatcactatcgatgcgattaacaaccgaatcgatgtcgacatcactgacgaggagatggagaagcgaaggagtgagtggaagcctcctgcgccccgtgttacgaggggtgtgttggccaagtatgcccgcttggtcggtgatgcttcccacggtgctgtaacagatcagtggtag

SEQ ID NO: 486 - protein, 600 aa, Gibberella zeae
MADQVTHDPKQSSDYIPFPCLPPGGALNRWSTKITREHDYPGAQAMLYGAGVKDQHTMKNAPQVGVATVWWQGNPCNTHLLDLGQIVKNSIEKEGMIGWQFNTVGVSDAITMGGEGMRFSLQTREIIADSIESVTCAQHHDANISIPGCDKNMPGTVMAAARHNRPFIMIYGGTIRKGHSNLLEKPINISTCYEASGAFNYGRLHAKTNPGEPGRESSDVMDDIEKHACPGAGACGGMYTANTMATAIEAMGLTLPGSSSYPAESPEKRRECERAAQVIRTTMEKDLRPRDIMTRASFENALVLTMILGGSTNGVLHFLAMANTADVPLTIDDIQRASDRTPFLADLAPSGKYYMEDLYKVGGTPSVIKMLVARGLLDGSIMTITGKTLAENVADWPSLDPGQDIIRPLENPIKDSGHIRILKGNFAPGGAVAKITGKEGLSFTGKARVFNTEKELNGALNRSEIKQSDGNLVVIVRYEGPKGGPGMPEQLKASAAIMGAGLSNLALVTDGRYSGASHGFIVGHVVPEAMVGGPIALVKDGDEITIDAINNRIDVDITDEEMEKRRSEWKPPAPRVTRGVLAKYARLVGDASHGAVTDQW

SEQ ID NO: 487 - DNA, 1923 bp, Neurospora crassa
atggcttccaaccaagataataaggctgtcgctcccgacgccgccgctcccgccggccagtccaccaccaccacgaccaccaacgacaacagcgagcgcaacttgcccaaagagggcgaatacatccaatggcgtactctcccagctggcaaccccgaccagttgaaccgctggtcgcactttttgactcgtgagcatgagtttcctggagctcaggccatgctctacggcgccggtgtcccgaataaggacatgatgaagaaggcgccgcatgtcggcattgcgacggtctggtgggagggcaacccctgcaacacccatttgctggatcttggccaaaaggtcaagaaggccgttgagcgcgagaagatgcttgcgtggcagttcaacaccattggtgtctcggatggtatcaccatgggcggagagggcatgcgctactcgcttcagtctcgcgagatcatcgccgactccatcgagaccgtgacgtgcgctcagcatcatgacgccaacatctccattcccggctgcgacaagaacatgcccggtgtcatcatggccgcggcccgccacaaccgtcccttcgtcatgatctacggcggcaccatgcgcggcggccactcggagctcctcgaccgccccatcaacatcgtcacttgctacgaggcttccggcgcttacacgtatggccgtctcaagcccgcttgccccaacagcaccgccaccccttcggacgtcatggacgacatcgagcagcacgcctgccccggcgccggcgcctgcggcggcatgtacaccgccaacaccatggcgaccgccatcgaagccatgggcctcaccgcaccgggctcctcttctttccctgcctcttcgcccgaaaagttccgcgagtgcgaaaaagccgccgagtacatcaagatctgtatggagaaggacattcgcccgcgcgacctcttgaccaaggcctcgttcgagaacgccctcgtgctcaccatgatcctcggcggttctaccaatggcgttctgcactacctcgccatggccaactcggccgacgtcgacttgactctggacgacatcaaccgcgtctcagccaagacgccctttttggctgacatggccccctccggcaggtactacatggaagacctgtacaaagtcggcggcacccccgcggtcctcaagatgctcatcgccgcaggctatatcgatggcaccatccccactatcaccggcaagtctttggcggaaaacgtatccgactggcctagtctcgaccccgatcaaaaaatcatccgcccccttgacaaccccatcaagtcccaggggcatatccgtgtcttgtacggaaacttctcccccggtggtgcggtcgccaagattacaggcaaggaaggtctctccttcaccggcaaagcccgttgtttcaacaaggaattcgagctcgacgccgccttgaagaactcggaaattaccctcgagcaaggaaaccaggtcctcatcgtgcggtacgaaggacccaaaggcggtccaggtatgccagagcaactgaaggcttcagcggcgatcatgggcgcgggcctgacgaatgtcgcgctggtgacggatggtcggtactctggtgcgtcgcatgggtttattgtgggccatgtggtccccgaggcggcgacgggggggccgattgcgctggtgaaggacggggatttgattacgattgatgcggttaggaaccggattgatgtcgtcaagactgtggaaggcgtcgagggtgaggaagagattgccaaggtgttggaggagagaaagaaggggtggaaggcgccgaagatgaagccgacgaggggggcgttggccaagtatgcgaggttggtgggggatgcgtcgcatggggctgttactgatttgggtggggatgcctattag

SEQ ID NO: 488 - protein, 640 aa, Neurospora crassa
MASNQDNKAVAPDAAAPAGQSTTTTTTNDNSERNLPKEGEYIQWRTLPAGNPDQLNRWSHFLTREHEFPGAQAMLYGAGVPNKDMMKKAPHVGIATVWWEGNPCNTHLLDLGQKVKKAVEREKMLAWQFNTIGVSDGITMGGEGMRYSLQSREIIADSIETVTCAQHHDANISIPGCDKNMPGVIMAAARHNRPFVMIYGGTMRGGHSELLDRPINIVTCYEASGAYTYGRLKPACPNSTATPSDVMDDIEQHACPGAGACGGMYTANTMATAIEAMGLTAPGSSSFPASSPEKFRECEKAAEYIKICMEKDIRPRDLLTKASFENALVLTMILGGSTNGVLHYLAMANSADVDLTLDDINRVSAKTPFLADMAPSGRYYMEDLYKVGGTPAVLKMLIAAGYIDGTIPTITGKSLAENVSDWPSLDPDQKIIRPLDNPIKSQGHIRVLYGNFSPGGAVAKITGKEGLSFTGKARCFNKEFELDAALKNSEITLEQGNQVLIVRYEGPKGGPGMPEQLKASAAIMGAGLTNVALVTDGRYSGASHGFIVGHVVPEAATGGPIALVKDGDLITIDAVRNRIDVVKTVEGVEGEEEIAKVLEERKKGWKAPKMKPTRGALAKYARLVGDASHGAVTDLGGDAY

SEQ ID NO: 489 - DNA, 1575 bp, Coprinopsis cinerea
atggataaaccccagatcggtatttcgccggtctggtgggaaggcaatccatgcaatttccacctccttgaccttgcaaagcatgtcaagaaaggctgtcaagaagaagaccagattgggttgatctttaataccatcggtgtcagtgatgccattacgatgggtacagacggaatgcggtacagtctacccagtcgagacctcatcgcggactccatcgaagcagtcgtcatggcccagcactacgacggaaacatcgctattcctggatgcgacaagaacatgcccggctgcttcatggctgctgtccgacacaaccgaccgaccattatcgtctatggagggactatccaacctggtacccggcacgttggtgcctttactgtgggcaagatcaccgatgagcagaggttcgacgttgtgcgacatgcctgtcctggccccggagcctgcggcggaatgtacactgcgaacacgatgagttctgccctcgaggtcctcggcttgtcgctcccgtattcttcaagtatcccagcgatgcatccagagaaggtccaagaatgcttcagggctgccaagtacatgaagaagctgcttgagttggatttgaagcccagggatatcttgacgaagcagtccttcctgaatgccattgtcatcatcaccgttctgggaggctccacgaacgcggttctccacttgttggcaatggcccgagctgctgagattgatctcaccatcgacgacttccaagctgtagcagacaggacaccattcctggccgacctcatgccgtcaggtcgctattacatggaagacatccaccgcattggcggcatccccgccatcgtcaagtatttgttgaaccactccgatctcatcgacggaaaccagatgactgtcactggaaagacgctggctgagaacctagcggatgttcctgagcttgagttccataaccaggacgtcttccgtccactggacaatcctatcaagccgacaggtcatatcacgatcttgagaggtaacctggcgccagaaacagctgttgcgaagctcactggcaaagagggactgagattcgagggtgtcgcgcgttgcttcgatagcctcgagaagttctaccccgctcttgctgcaggggaaatcaaacccggaactgtcctaatcttcagatatcaaggtcccaaaggtgcacccggtatgccggagatgttgggtatgagcgctgcatcgcgtggtccaactggagctatcgcaggcgctggcttggccaactcgactgcgttgatcacggacggccgtttctctggcgccagccgagggtttattattgggcacgtcgtcccagaggcacgagttggcggacccattgcccttgtcaaggacggagacaagatcgtcatcgacgccgagactcgaacaatcaactggctcgtggatgaggaagaacaagcaaagaggaggaaagaatgggaggcgtcggataacggcaagttgaatgtgaagagaggagttttgtaccgatatgccagagatgtcgcgcctgcaagcatgggagcatattgtgattga

SEQ ID NO: 490 - protein, 524 aa, Coprinopsis cinerea
MDKPQIGISPVWWEGNPCNFHLLDLAKHVKKGCQEEDQIGLIFNTIGVSDAITMGTDGMRYSLPSRDLIADSIEAVVMAQHYDGNIAIPGCDKNMPGCFMAAVRHNRPTIIVYGGTIQPGTRHVGAFTVGKITDEQRFDVVRHACPGPGACGGMYTANTMSSALEVLGLSLPYSSSIPAMHPEKVQECFRAAKYMKKLLELDLKPRDILTKQSFLNAIVIITVLGGSTNAVLHLLAMARAAEIDLTIDDFQAVADRTPFLADLMPSGRYYMEDIHRIGGIPAIVKYLLNHSDLIDGNQMTVTGKTLAENLADVPELEFHNQDVFRPLDNPIKPTGHITILRGNLAPETAVAKLTGKEGLRFEGVARCFDSLEKFYPALAAGEIKPGTVLIFRYQGPKGAPGMPEMLGMSAASRGPTGAIAGAGLANSTALITDGRFSGASRGFIIGHVVPEARVGGPIALVKDGDKIVIDAETRTINWLVDEEEQAKRRKEWEASDNGKLNVKRGVLYRYARDVAPASMGAYCD

SEQ ID NO: 491 - DNA, 1767 bp, Laccaria bicolor
atgtcagctccgggagacgtttacattcacgatgtcctcaagaaatcgagcctccccgattcgaagttgaacaggatatcctgtcaattaacgcaaaacaagattcggggtggcgctcaggcgatgctttacgctgtcggtttgagtgaggacgatatgaacaagcctcagattgggatttctccagtgtggtgggaagggaacccatgtaactctcaccttcttgaccttgccaagcacgtaaaggaaggttgtaaagcagaggatcttgttggtcttatcttcaataccattggcgtcagcgacgcgattacgatgggaacagatggaatgagatattctctgccaagtcgagatatcattgcagattcaatcgaagctgctcaacattacgacgccaacatctcaataccagggtgtgacaagaacatgccaggttgcttcatcgccgcagtccgtcataatcgaccaacgatcattgtttacggtggaactattcaaccgggcgtccggcatgtcgattgcccttcgatgggcaaggaaaaaggtggatcagtgaatatctctgacgcatttgaatcttatggggcattcgccgttggaaaaattaacgacgtggagcgatttgatgtcgttcgccacgcatgtcctggcgcaggggcttgtggaggcatgtacactgcgaacaccatgagttcagcccttgaggctcttgggatatctttgccctattcatcgagcacgccagccctgtaccccgagaaggttcaagagtgttttcgagcagcaaagtatttaaaacgtttgcttgaattagatctgaagcccaaggacattttgacccgaaactcgtttttaaatgctatcgtcatcataaccgttctcggtggctccacgaatgcagttttgcacttgctagctatggctcgcgcagctgaggtagaactcacaatcgatgacttccaaatgattgcagacaaaacgcctttcctggccgatttaatgccttcagggaggtattatatggaggatatccacaagatcggaggaatccctgccattctgaaatacctattgaaccacaccgatcttatcgatgggacacagatgacggtgaccgggcgtactttggcagaaaacctcgcagatgtacctgagctcgagttcgataagcaagatgttgttcgaagcttgagcaatcctatcaagaaaacgggccatatcacgatcatgcggggaaatctagctccagagacggccgtagccaaactcacagggaaagaaggtctcaaatttgagggaattgcgagatgctttgatagcttggatggattctatccagcgcttgaggcgggtgagatcaaggcaggcacggtgcttatctttaggtatcaaggaccaaaaggtgcacccggtatgcccgagatgcttggtccaacaggagccattgcaggcgctggacttgctcgttccacagccttaataacagatggtcgcttctcaggagccagtcgaggatttatcataggtcacgtcgtgccggaagcccgtgttggaggacctatcgcactcgttaagaatggggaccgaatcgtcattgattccgagacccgaacgatcaactggctggttgatgagaacgaacaaaaactgcgcaaggcagaatgggatgcctcagagaattcgaaattcaatgtcgggcggggtgtacttttgaggtacgctcgagatgtcgcaccggccaaccttggagcatattgcgattga

SEQ ID NO: 492 - protein, 588 aa, Laccaria bicolor
MSAPGDVYIHDVLKKSSLPDSKLNRISCQLTQNKIRGGAQAMLYAVGLSEDDMNKPQIGISPVWWEGNPCNSHLLDLAKHVKEGCKAEDLVGLIFNTIGVSDAITMGTDGMRYSLPSRDIIADSIEAAQHYDANISIPGCDKNMPGCFIAAVRHNRPTIIVYGGTIQPGVRHVDCPSMGKEKGGSVNISDAFESYGAFAVGKINDVERFDVVRHACPGAGACGGMYTANTMSSALEALGISLPYSSSTPALYPEKVQECFRAAKYLKRLLELDLKPKDILTRNSFLNAIVIITVLGGSTNAVLHLLAMARAAEVELTIDDFQMIADKTPFLADLMPSGRYYMEDIHKIGGIPAILKYLLNHTDLIDGTQMTVTGRTLAENLADVPELEFDKQDVVRSLSNPIKKTGHITIMRGNLAPETAVAKLTGKEGLKFEGIARCFDSLDGFYPALEAGEIKAGTVLIFRYQGPKGAPGMPEMLGPTGAIAGAGLARSTALITDGRFSGASRGFIIGHVVPEARVGGPIALVKNGDRIVIDSETRTINWLVDENEQKLRKAEWDASENSKFNVGRGVLLRYARDVAPANLGAYCD

SEQ ID NO: 493 - DNA, 1794 bp, Ustilago maydis
atggtcaacggagaagtcgagctgcgcacaacttcgcgcaccaatggtgacgctcccgccccgatcctgaacaggatcagtcgatacatcacgcaatcctccgacaagggagctgctcaatccatgcttcacgcgtgcggtctttcggtacaagacctcgacaagccccaggttggcatctcatctgtatggtgggaaggcaacccatgcaatactcacctgctcgaatttggccgcaagatcaagcaaggctgcgaagcggaaggtctggtgggcttgcaaaataacacggtgggcgtttccgatgccatcaccatgggcggccccggaatgcagtattcgcttccttcgagagagctgatcgccgactctatcgagacgatcaccctcgcgcagtatcatgacgctaatgtgtccatccccggttgtgacaagaacatgcctggctgtctcattgcttgtctgcgtcacaaccgcccatcaatcatcgtttatggcggcacgatccaacccggcaagcacggaatggacatacccgctcttggaaggaagaagggcgacccatgcaatgtcgccgacaatttcgaagcgacaggagcttacgccaagggcctcatcacggcagaagagcgtgtcgacctgatccgcaacgcctgtcccggtcctggtgcttgcggaggcatgtacaccgccaacaccttgtctatcgcgatcgaagtcatggggatgggtctcccgttgaccagcagtactcccgctgtctaccctgaaaagatgcaagaatgtctgcgtgttggagcctacatcaagaatctgctagccaaggatatcaagcctcgcgacatcatgaccaagaaggcttttgagaatgctatcgtgatgactcatgttcttggtggctcgactaatgctgttctccatctcatcgctgttgcacgtgctggcgatatcgacattaccatcgacgacttccaaaggctcggcgacaagacacccatgttggccgacgtcaagccatcgggcaagtattacatggaagacattcacaagatcggaggtgttcctcgtgtgctcaagtacattctggagaacacggatctgcttcatggtgacgtgatgacggtgacgggtaaaacgatgcgcgagaatctcgtcgatgttgaaccactggagtttgagacgcaagatatcatccgacctctcagcaaccctatcaaggcaacgggccacctgaccatcatgcgtggatcgctgtgccccggcggagctgtgtccaagctgacgggcaaagaggggctgtactttgacggcagcgctgttgtctttgactctgaagacggcatcaccgaagcaatcgcagaaggccgtgtcaaagaaggcagcgttgtcgtcattcgctatgttggaccaaaaggtggtcctggtatgcccgagatgctcggaccaaccggtgcgatcatgggcgcaggtctcggaaaaacagtagcgctcatcaccgacggtcgtttctctggcgcttcgcacggattttgcacaggacatgttgtgccagaagcagccctgggaggaccgatcgcgctcgtacaagacggagacaggatcactgtcgatgccaacacgcgcgagatcaacttgcacatcagtgacgaagagatggagaagaggaaacagtggtggctcaaagagaaaaagcctactctgacaaagaaacacaagcgcggttggctgtacaagtttgcaagggatgtacaaaacgcttccgagggttgtgttactgatcgcgatctgttttga

SEQ ID NO: 494 - protein, 597 aa, Ustilago maydis
MVNGEVELRTTSRTNGDAPAPILNRISRYITQSSDKGAAQSMLHACGLSVQDLDKPQVGISSVWWEGNPCNTHLLEFGRKIKQGCEAEGLVGLQNNTVGVSDAITMGGPGMQYSLPSRELIADSIETITLAQYHDANVSIPGCDKNMPGCLIACLRHNRPSIIVYGGTIQPGKHGMDIPALGRKKGDPCNVADNFEATGAYAKGLITAEERVDLIRNACPGPGACGGMYTANTLSIAIEVMGMGLPLTSSTPAVYPEKMQECLRVGAYIKNLLAKDIKPRDIMTKKAFENAIVMTHVLGGSTNAVLHLIAVARAGDIDITIDDFQRLGDKTPMLADVKPSGKYYMEDIHKIGGVPRVLKYILENTDLLHGDVMTVTGKTMRENLVDVEPLEFETQDIIRPLSNPIKATGHLTIMRGSLCPGGAVSKLTGKEGLYFDGSAVVFDSEDGITEAIAEGRVKEGSVVVIRYVGPKGGPGMPEMLGPTGAIMGAGLGKTVALITDGRFSGASHGFCTGHVVPEAALGGPIALVQDGDRITVDANTREINLHISDEEMEKRKQWWLKEKKPTLTKKHKRGWLYKFARDVQNASEGCVTDRDLF

SEQ ID NO: 495 - DNA, 999 bp, Lactobacillus plantarum
atgaaaattattgcatatgctgtacgtgatgacgaacgtccattcttcgatacttggatgaaagaaaacccagatgttgaagttaaattagttccagaattacttactgaagacaacgttgacttagctaaaggcttcgacggtgccgatgtataccaacaaaaggactatactgctgaagtattgaacaagttagccgacgaaggggttaagaacatctctcttcgtaacgttggtgttgataacttggacgttcctactgttaaagcacgtggcttaaacatttctaacgtacctgcatactcaccaaatgcgattgctgaattatcagtaacgcaattgatgcaattattacgtcaaaccccattgttcaataagaagttagctaagcaagacttccgttgggcaccagatattgccaaggaattaaacaccatgactgttggtgttatcggtactggtcggattggccgtgctgccatcgatattttcaaaggcttcggcgctaaggttatcggttacgatgtttaccggaatgctgaacttgaaaaggaaggcatgtacgttgacaccttggacgaattatacgcccaagctgatgttatcacgttacacgttcctgcattgaaggataactaccacatgttgaatgcggatgccttcagcaagatgaaagatggcgcctacatcttgaactttgctcgtgggacactcatcgattcagaagacttgatcaaagccttagacagtggcaaagttgccggtgccgctcttgatacgtatgaatacgaaactaagatcttcaacaaagaccttgaaggtcaaacgattgatgacaaggtcttcatgaacttgttcaaccgcgacaatgttttgattacaccacatacggctttctacactgaaactgccgttcacaacatggtgcacgtttcaatgaacagtaacaaacaattcatcgaaactggtaaagctgatacgcaagttaagtttgactaa

SEQ ID NO: 496 - protein, 332 aa, Lactobacillus plantarum
MKIIAYAVRDDERPFFDTWMKENPDVEVKLVPELLTEDNVDLAKGFDGADVYQQKDYTAEVLNKLADEGVKNISLRNVGVDNLDVPTVKARGLNISNVPAYSPNAIAELSVTQLMQLLRQTPLFNKKLAKQDFRWAPDIAKELNTMTVGVIGTGRIGRAAIDIFKGFGAKVIGYDVYRNAELEKEGMYVDTLDELYAQADVITLHVPALKDNYHMLNADAFSKMKDGAYILNFARGTLIDSEDLIKALDSGKVAGAALDTYEYETKIFNKDLEGQTIDDKVFMNLFNRDNVLITPHTAFYTETAVHNMVHVSMNSNKQFIETGKADTQVKFD

SEQ ID NO: 497 - DNA, 963 bp, Lactobacillus plantarum
ttgtcaagcatgccaaatcatcaaaaagttgtgttagtcggcgacggcgctgttggttctagttacgcttttgccatggcacaacaaggaattgctgaagaatttgtaattgtcgatgttgttaaagatcggacaaagggtgacgcccttgatcttgaagacgcccaagcattcaccgctcccaagaagatttactcaggcgaatattcagattgtaaggacgctgacttagttgttattacagccggtgcgcctcaaaagcctggtgaatcacgtttagacttagttaacaagaatttaaatatcctatcatccattgtcaaaccagttgttgactccggctttgacggcatcttcttagttgctgctaaccctgttgacatcttaacttacgctacttggaaattctcaggtttcccaaaggatcgtgtcattggttcagggacttccttagactcttcacgtttacgcgttgcgttaggcaaacaattcaatgttgatcctcgttccgttgatgcttacatcatgggtgaacacggtgattctgaatttgctgcttactcaactgcaaccatcgggacacgtccagttcgcgatgtcgctaaggaacaaggcgtttctgacgaagatttagccaagttagaagacggtgttcgtaacaaagcttacgacatcatcaacttgaagggtgccacgttctacggtatcgggactgctttaatgcggatttccaaagccattttacgtgatgaaaatgccgttttaccagtaggtgcctacatggacggccaatacggcttaaacgacatttatatcgggactccggctgtgattggtggaactggtttgaaacaaatcatcgaatcaccactttcagctgacgaactcaagaagatgcaagattccgccgcaactttgaaaaaagtgcttaacgacggtttagctgaattagaaaataaataa

SEQ ID NO: 498 - protein, 320 aa, Lactobacillus plantarum
MSSMPNHQKVVLVGDGAVGSSYAFAMAQQGIAEEFVIVDVVKDRTKGDALDLEDAQAFTAPKKIYSGEYSDCKDADLVVITAGAPQKPGESRLDLVNKNLNILSSIVKPVVDSGFDGIFLVAANPVDILTYATWKFSGFPKDRVIGSGTSLDSSRLRVALGKQFNVDPRSVDAYIMGEHGDSEFAAYSTATIGTRPVRDVAKEQGVSDEDLAKLEDGVRNKAYDIINLKGATFYGIGTALMRISKAILRDENAVLPVGAYMDGQYGLNDIYIGTPAVIGGTGLKQIIESPLSADELKKMQDSAATLKKVLNDGLAELENK

SEQ ID NO: 499 - DNA, 930 bp, Lactobacillus plantarum
atggataagaagcaacgcaaagtcgtaattgttggtgatggctcggtgggttcatcatttgccttttcattggtccaaaattgcgccctagatgaactcgttatcgttgacttggttaaaacgcacgcagagggggacgttaaggatttggaagatgttgccgcctttacgaatgcgaccaacattcataccggtgaatatgcggatgcgcgtgatgctgacatcgttgtcattacggctggtgtgcctcgtaagcctggtgagagtcgtttagatttgattaaccgcaatacgaagattctggaatccatcgtcaaaccagtggttgcgagtggttttaatggttgcttcgttatctcaagtaatcccgtcgatattttgacttcgatgacgcaacgtttatccggttttccacggcatcgggtcattggtaccgggacttccttggatacggcgcggttacgggtcgccttggctcagaagttgaatgttgccaccactgcagttgatgctgcggtacttggagaacatggtgatagttccatcgttaattttgatgaaattatgatcaatgctcagcccttaaagacggtcacaacggtcgatgatcagttcaaagctgaaatcgagcaagctgttcgtggtaaaggtggtcaaatcattagtcagaagggggccacgttctatggggtcgccgttagtttgatgcaaatctgccgagcaattttgaacgatgaaaatgctgagttgattgtctccgccgctttgtctggtcaatatggcattaacgatttgtacttggggtcacccgccattattaaccgcaacgggctccaaaaagtgatcgaagctgagctatcagatgatgagcgtgcccggatgcaacatttcgcagccaagatgctgaccatgatgaatgtggcatcataa

SEQ ID NO: 500 - protein, 309 aa, Lactobacillus plantarum
MDKKQRKVVIVGDGSVGSSFAFSLVQNCALDELVIVDLVKTHAEGDVKDLEDVAAFTNATNIHTGEYADARDADIVVITAGVPRKPGESRLDLINRNTKILESIVKPVVASGFNGCFVISSNPVDILTSMTQRLSGFPRHRVIGTGTSLDTARLRVALAQKLNVATTAVDAAVLGEHGDSSIVNFDEIMINAQPLKTVTTVDDQFKAEIEQAVRGKGGQIISQKGATFYGVAVSLMQICRAILNDENAELIVSAALSGQYGINDLYLGSPAIINRNGLQKVIEAELSDDERARMQHFAAKMLTMMNVAS

SEQ ID NO: 501 - DNA, 978 bp, Lactococcus lactis
atggctgataaacaacgtaaaaaagttatccttgtaggtgacggtgctgtaggttcatcatacgcttttgctcttgtaaaccaagggattgcacaagaattaggaattgttgacctttttaaagaaaaaactcaaggagatgcagaagacctttctcatgccttggcatttacttcacctaaaaagatttactctgcagactactctgatgcaagcgacgctgacctcgtagtcttgacttctggtgctccacaaaaaccaggtgaaactcgtcttgaccttgttgaaaaaaatcttcgtatcactaaagatgttgtcactaaaattgttgcttcaggtttcaaaggaatcttccttgttgctgctaacccagttgatatcttgacatacgctacttggaaattctcaggtttccctaaaaaccgcgttgtaggttcaggtacttcacttgatactgcacgtttccgtcaagcattggcagaaaaagttgatgttgacgctcgttcaatccacgcatacatcatgggtgaacacggtgactcagaatttgccgtttggtcacacgctaacgttgctggtgttaaattggaacaatggttccaagaaaatgactaccttaacgaagctgaaatcgttgaattgtttgaatctgtacgtgatgctgcttactcaatcatcgctaaaaaaggtgcaacattctatggtgtcgctgtagctcttgctcgtattactaaagcaattcttgatgatgaacatgcagtacttccagtatcagtattccaagatggacaatatggcgtaagcgactgctaccttggtcaaccagctgtagttggtgctgaaggtgttgttaacccaatccacattccattgaatgatgctgaaatgcaaaaaatggaagcttctggtgctcaattgaaagcaatcattgacgaagcttttgctaaagaagaatttgcttctgcagttaaaaactaa

SEQ ID NO: 502 - protein, 325 aa, Lactococcus lactis
MADKQRKKVILVGDGAVGSSYAFALVNQGIAQELGIVDLFKEKTQGDAEDLSHALAFTSPKKIYSADYSDASDADLVVLTSGAPQKPGETRLDLVEKNLRITKDVVTKIVASGFKGIFLVAANPVDILTYATWKFSGFPKNRVVGSGTSLDTARFRQALAEKVDVDARSIHAYIMGEHGDSEFAVWSHANVAGVKLEQWFQENDYLNEAEIVELFESVRDAAYSIIAKKGATFYGVAVALARITKAILDDEHAVLPVSVFQDGQYGVSDCYLGQPAVVGAEGVVNPIHIPLNDAEMQKMEASGAQLKAIIDEAFAKEEFASAVKN

SEQ ID NO: 503 - DNA, 996 bp, Leuconostoc mesenteroides
atgaagatttttgcttacggcattcgtgatgatgaaaagccatcacttgaagaatggaaagcggctaacccagagattgaagtggactacacacaagaattattgacacctgaaacagctaagttggctgagggatcagattcagctgttgtttatcaacaattggactatacacgtgaaacattgacagctttagctaacgttggtgttactaacttgtcattgcgtaacgttggtacagataacattgattttgatgcagcacgtgaatttaactttaacatttcaaatgttcctgtttattcaccaaatgctattgcagaacactcaatgattcaattatctcgtttgctacgtcgcacgaaagcattggatgccaaaattgctaagcacgacttgcgttgggcaccaacaattggacgtgaaatgcgtatgcaaacagttggtgttattggtacaggtcatattggccgtgttgctattaacattttgaaaggctttggggccaaggttattgcttatgacaagtacccaaatgctgaattacaagcagaaggtttgtacgttgacacattagacgaattatatgcacaagctgatgcaatttcattgtatgttcctggtgtacctgaaaaccatcatctaatcaatgcagatgctattgctaagatgaaggatggtgtggttatcatgaacgctgcgcgtggtaatttgatggacattgacgctattattgatggtttgaattctggtaagatttcagacttcggtatggacgtttatgaaaatgaagttggcttgttcaatgaagattggtctggtaaagaattcccagatgctaagattgctgacttgattgcacgcgaaaatgtattggttacgccacacacggctttctatacaactaaagctgttctagaaatggttcaccaatcatttgatgcagcagttgctttcgccaagggtgagaagccagctattgctgttgaatattaa

SEQ ID NO: 504 - protein, 331 aa, Leuconostoc mesenteroides
MKIFAYGIRDDEKPSLEEWKAANPEIEVDYTQELLTPETAKLAEGSDSAVVYQQLDYTRETLTALANVGVTNLSLRNVGTDNIDFDAAREFNFNISNVPVYSPNAIAEHSMIQLSRLLRRTKALDAKIAKHDLRWAPTIGREMRMQTVGVIGTGHIGRVAINILKGFGAKVIAYDKYPNAELQAEGLYVDTLDELYAQADAISLYVPGVPENHHLINADAIAKMKDGVVIMNAARGNLMDIDAIIDGLNSGKISDFGMDVYENEVGLFNEDWSGKEFPDAKIADLIARENVLVTPHTAFYTTKAVLEMVHQSFDAAVAFAKGEKPAIAVEY

SEQ ID NO: 505 - DNA, 987 bp, Streptococcus thermophilus
atgactgcaactaaactacacaaaaaagtcatccttgttggtgacggtgccgtaggttcatcttacgctttcgcacttgtaaaccaaggtatcgctcaagaactaggtatcatcgaaattccacaattatttgaaaaagccgttggtgatgcgcttgaccttagccacgcacttcctttcacttcacctaaaaaaatctatgcagctaaatatgaagactgtgcggatgctgaccttgtagttatcactgctggtgctcctcaaaaaccaggtgagactcgtcttgatcttgttggtaaaaaccttgcaatcaacaaatcaatcgttactcaagttgttgaatcaggattcaacggtattttccttgtagctgctaacccagtagacgtattgacttactctacatggaagttctcaggattccctaaagaacgcgttatcggttcaggtacttcacttgactcagctcgtttccgtcaagcacttgctgaaaaacttaatgtcgatgctcgttcagttcacgcttacatcatgggtgaacacggcgactcagagtttgcggtttggtcacacgctaacatcgccggtgtaaaccttgaagagttccttaaagacgaagaaaacgttcaagaagctgaattagttgaattgttcgaaggtgttcgtgatgcagcttacacaattatcaacaaaaaaggtgctacatactacggtatcgcagtagcccttgctcgtatcactaaagctatccttgacgatgaaaatgcagtacttccattgtctgtattccaagaaggtcaatatggtgtaaacaacatctttatcggtcaacctgctattgtaggcgcacacggtatcgtacgtccagtaaacatcccattgaacgatgctgaacaacaaaagatgaaggcttctgccgatgaattgcaagctatcattgatgaagcatggaaaaaccctgaattccaagaagcttcaaaaaactaa

SEQ ID NO: 506 - protein, 328 aa, Streptococcus thermophilus
MTATKLHKKVILVGDGAVGSSYAFALVNQGIAQELGIIEIPQLFEKAVGDALDLSHALPFTSPKKIYAAKYEDCADADLVVITAGAPQKPGETRLDLVGKNLAINKSIVTQVVESGFNGIFLVAANPVDVLTYSTWKFSGFPKERVIGSGTSLDSARFRQALAEKLNVDARSVHAYIMGEHGDSEFAVWSHANIAGVNLEEFLKDEENVQEAELVELFEGVRDAAYTIINKKGATYYGIAVALARITKAILDDENAVLPLSVFQEGQYGVNNIFIGQPAIVGAHGIVRPVNIPLNDAEQQKMKASADELQAIIDEAWKNPEFQEASKN

SEQ ID NO: 507 - DNA, 996 bp, Pediococcus pentosaceus
atgaaaattattgcttatggcattcgagatgacgaaaaaccttacctagaagaatgggttaaagataataaaattgaagtaaaggctgttagcgaattgttggactccaacacgattgaacaagctaagggttatgacggagttgttgcatatcaacagaaaccttatacagatgatttgttcgataaaatgaatgaattcgggattcatgccttttcgcttcgtaacgttggtgttgataatgttccagttgaggctttaaagcgaaataatattaagattaccaatgttccagcgtactctccaatggcgattgcagaactttcagtaacccaactcctagctttaattcgtcgaattccagaatttgatgctaagatggctcgtggtgatttcagatgggaaccagatattgctctagaacttaaccaaatgacagtaggagttattggtaccggaagaattgggcgtgcggccattaatatctttaaaggctttggagctaaagtgattgcttatgatgttttccgaaattcagaacttgaaaaagaaggaatctatgttgactcgcttgaagaactttatcgtcaagtagatgttattaccttacatgttcccgctttaaaagataactaccatatgttaaatgatgaagcgttcgcacagatgcatgatggggtatttgttctaaattttgctcgcggtagcttgattgacacgaaggcattacttaaggctttagatagtggtaaggtggctggtgcggcactagatacctatgaagacgaagtaggtatttttgatgtggatcaccaaaatgacccaatcaatgatcccgtatttaatgatttatacagtagacgtaatgtaaaaatcacaccacatgcggctttttatactaagccagcagttaaaaatatggtacaaattgctcttgaaaataataaagcactaattgaaaaaggtgctgcaagaaatgaagttaagtttgactaa

SEQ ID NO: 508 - protein, 331 aa, Pediococcus pentosaceus
MKIIAYGIRDDEKPYLEEWVKDNKIEVKAVSELLDSNTIEQAKGYDGVVAYQQKPYTDDLFDKMNEFGIHAFSLRNVGVDNVPVEALKRNNIKITNVPAYSPMAIAELSVTQLLALIRRIPEFDAKMARGDFRWEPDIALELNQMTVGVIGTGRIGRAAINIFKGFGAKVIAYDVFRNSELEKEGIYVDSLEELYRQVDVITLHVPALKDNYHMLNDEAFAQMHDGVFVLNFARGSLIDTKALLKALDSGKVAGAALDTYEDEVGIFDVDHQNDPINDPVFNDLYSRRNVKITPHAAFYTKPAVKNMVQIALENNKALIEKGAARNEVKFD

SEQ ID NO: 509 - DNA, 984 bp, Pediococcus pentosaceus
atgaaaaatattcattctcatcgtaaagatgaacacatttcattggctgaaaaattttacagcccgactgccagtgctgggtttgatacaattcgcttattaccaaatgcattacctgaaacaggaatttcagaggttagtttagaaactaccctggcagggctaaaaatgcccctccccttcttcattcaggctatgacgggtggaagtgcctacaccgccaaattaaatgcacggcttgctaaaattgcgcaagaaactgatttagcgatggccgttggctctcaatcagtcgctttaaaatatcctgaactagcagacacatttaaaattgtgcgagaaactaatccccaaggattgattatggcgaatgttggggcggatgctagtgttgctaaagcgcaggcagctgtagacatgcttcaagcgaacgccctacagttacatatcaatgttgctcaggagctagttatgcctgagggtgaccgtacctttgattacctagatcatattgctgaaatcgtttctaacctgaaagtacccgtgattgttaaagcggtcggtgcgggaatgactcatcaagatgccctcgccctaaaaaaagttggcgtaaagtttattgatgttggtggtcgaggcggtactaactttattcaaatcgaaaatgctcgtcgtcacactaaagattttgattttatgacatcgtttggtttaacaacggtagagtcacttaaatcaattacggttgatggcttgtcaattaccgctactggcggtattcgtaattcaagtgatattattaaaagtctggctttaggggctgataacgtgggaattgcgggctacttcctccatcagctactccaccatgacgatgcatttatggttgaaatgattgagcagatgaagtaccaactaaagagcctcttggtactgttgggcgttaaatctatcaacgaactttctgagaaaaatttattttaa

SEQ ID NO: 510 - protein, 320 aa, Pediococcus pentosaceus
MSKIQNHQKVVLVGDGAVGSSYAFAMAQQGIAEEFVIVDVVKDRTVGDALDLEDATPFTAPKNIYSGEYSDCKDADLVVITAGAPQKPGETRLDLVNKNLNILSTIVKPVVDSGFDGIFLVAANPVDILTYATWKFSGFPKEKVIGSGISLDSARLRVALGKKFNVSPDSVDAYIMGEHGDSEFAAYSTASIGTKPLLDIAKEEGVSTDELAEIEDSVRNKAYEIINKKGATFYGVGTALMRISKAILRDENAVLPVGAYMDGEYGLNDIYIGTPAVINGQGLNRVIESPLSDDEMKKMTDSATTLKKVLTDGLKALEEK

SEQ ID NO: 511 - DNA, 972 bp, Lactobacillus acidophilus
atggcaagagttgaaaaacctcgtaaagttattttagttggtgacggtgctgtaggttctacctttgcattttcaatggtgcaacaaggtattgctgaagaattaggtatcattgatattgctaaggaacacgttgaaggtgacgcaatcgacttagcagatgctactccatggactttcccaaagaacatttacgcagctgactacgctgactgcaaggacgcagacttagtagttattactgctggtgctccacaaaagccaggtgaaactcgtcttgaccttgttaacaagaacttgaagattttatcatcaatcgttgaaccagttgttgaatcaggctttgaaggtatcttcttagtagttgctaacccagttgacatcttgactcacgcaacttggaagatttcaggcttccctaaggatcgcgttattggttcaggtacttcacttgatactggtcgtcttcaaaaggttatcggtaagatggaacacgttgacccacgttcagttaatgcatacatgcttggtgaacacggtgatactgaattcccagtatggagctacaacaatgttggtggcgtaaaggttagcgactgggttaaggctcacggtatggatgaatctaagcttgaagaaatccacaaggaagttgctgacatggcttacgacattatcaacaagaagggtgctactttctacggtatcggtacagcttcagcaatgatcgctaaggctatcttgaacgatgaacaccgtgtacttccactctcagttgcaatggatggtcaatacggtttacacgaccttcacattggtactcctgcagttgttggccgtaacggtcttgaacaaattattgaaatgcctttaaccgctgatgaacaagctaagatggaagcttctgctaagcaattaaaggaagttatggacaaagcctttgaagaaactggcgttaaggttcgtcaataa

SEQ ID NO: 512 - protein, 323 aa, Lactobacillus acidophilus
MARVEKPRKVILVGDGAVGSTFAFSMVQQGIAEELGIIDIAKEHVEGDAIDLADATPWTFPKNIYAADYADCKDADLVVITAGAPQKPGETRLDLVNKNLKILSSIVEPVVESGFEGIFLVVANPVDILTHATWKISGFPKDRVIGSGTSLDTGRLQKVIGKMEHVDPRSVNAYMLGEHGDTEFPVWSYNNVGGVKVSDWVKAHGMDESKLEEIHKEVADMAYDIINKKGATFYGIGTASAMIAKAILNDEHRVLPLSVAMDGQYGLHDLHIGTPAVVGRNGLEQIIEMPLTADEQAKMEASAKQLKEVMDKAFEETGVKVRQ

SEQ ID NO: 513 - DNA, 927 bp, Lactobacillus acidophilus
atgagtagaaaagtgtttcttgtaggtgatggtgctgttggttcaacttttgcaaatgacttattgcaaaatacaactgttgatgaattagcgatttttgatgttgctaaagatcgtccagttggtgattcaatggatttggaagatattactccatttacaggtcaaactaatattcatccagcagaatatagtgatgctaaagatgcagatgtgtgtgtaattactgctggtgttcctcgtaaacctggtgaaactagacttgacttagttaataagaatgtaaagattttaaagactattgttgatccggttgttgaatccggttttaagggtgtatttgttgtttcagctaacccggttgatattttaaccacattgactcaaaaaatatccggttttccaaaagatcgtgtaattggtactggtacttcacttgattcaatgcgtcttcgcgttgaattggcaaagaaacttaatgttccagtagctaaggttaactcaatggttcttggtgaacacggtgatactagttttgaaaactttgacgaatcaactgttgacaataagccacttcgcgattactcagaaatcaatgataatgttttaagtgaaattgagtcagacgtccgtaaaaagggtggaaagatcatcactaacaaaggagctacattctatggtgttgctatgatgcttactcaaattgttagtgctattttagataatcgttcaatttgtttgccattatcagccccaattaatggtgaatatggcattaagcatgatctttacttaggtactccaactataattaacggtaatggtattgaaaaagttattgaaactaaactttcagatgtagaaaaagctaagatgatcaattctgcagataagatgcaagaagttttatcaggtgttgaaatgtaa

SEQ ID NO: 514 - protein, 308 aa, Lactobacillus acidophilus
MSRKVFLVGDGAVGSTFANDLLQNTTVDELAIFDVAKDRPVGDSMDLEDITPFTGQTNIHPAEYSDAKDADVCVITAGVPRKPGETRLDLVNKNVKILKTIVDPVVESGFKGVFVVSANPVDILTTLTQKISGFPKDRVIGTGTSLDSMRLRVELAKKLNVPVAKVNSMVLGEHGDTSFENFDESTVDNKPLRDYSEINDNVLSEIESDVRKKGGKIITNKGATFYGVAMMLTQIVSAILDNRSICLPLSAPINGEYGIKHDLYLGTPTIINGNGIEKVIETKLSDVEKAKMINSADKMQEVLSGVEM

SEQ ID NO: 515 - DNA, 1050 bp, Lactobacillus acidophilus
atggtcatactaataaattttacggaggttaaatttatgacaaagatttttgcttacgctattcgtaaagacgaagaaccattcttaaacgaatggaaggaagctcacaaagatatcgatgttgattacactgataaacttttgactcctgaaactgcaaagcttgctgaaggtgcagacggtgttgttgtttaccaacaattagactacactcctgaaacccttcaagcattggcagatgctggcgtaactaagatgtcattacgtaacgttggtgtcgataacatcgacatggacaaggccaaagaattaggctttgaaatcactaatgttcctgtttactcaccagacgctattgctgaacatgctgctattcaagctgcacgtgtattacgtcaagacaagcgcatggacgaaaagatggctaaacgtgatttacgttgggcaccaactatcggccgtgaagttcgtgaccaagttgtcggtgttgttggtactggtcacattggtcaagtatttatgaagattatggaaggctttggcgcaaaagttattgcttacgatatcttcaagaaccctgaacttgaaaagaagggttactacgttgattcacttgatgacttgtacaagcaagctgatgtaatttcacttcacgtaccagacgttccagctaacgtacacatgattaacgatgaatcaatcgccaaaatgaaggatggcgttgtaatcgtaaactgctcacgtggtccacttgttgacactgatgcagtaattcgtggtttagactcaggcaagatcttcggcttcgttatggatacttacgaaggcgaagttggtgtatttaacaaggactgggaaggtaaagaattcccagacgaacgcttggcagacttaattgatcgtccaaacgtattggtaaccccacacactgccttctacactactcacgctgtacgtaacatggttgttaaggcatttgacaacaacttggaattaatcaagggcgaaaaaccagattctccagttgctttggacaagaacaagttctaa

SEQ ID NO: 516 - protein, 349 aa, Lactobacillus acidophilus
MVILINFTEVKFMTKIFAYAIRKDEEPFLNEWKEAHKDIDVDYTDKLLTPETAKLAEGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMKIMEGFGAKVIAYDIFKNPELEKKGYYVDSLDDLYKQADVISLHVPDVPANVHMINDESIAKMKDGVVIVNCSRGPLVDTDAVIRGLDSGKIFGFVMDTYEGEVGVFNKDWEGKEFPDERLADLIDRPNVLVTPHTAFYTTHAVRNMVVKAFDNNLELIKGEKPDSPVALDKNKF

SEQ ID NO: 517 - DNA, 1485 bp, Vibrio cholerae
atggcgaattatttcaatacgctgaatctgcgtgaacagttggatcaacttggtcgttgccgttttatggcgcgagaagagtttgcaaccgaagctgattacctaaaaggtaagaaagtggtgatcgtaggttgtggggctcaaggcctaaaccaaggcctcaatatgcgtgattcaggtttggatgtttcttacgctctgcgtcaggctgcgattgatgaacagcgtcagtcatttaagaatgccaagaataatggcttcaacgtgggtagttatgaacaactcatcccaaccgcagatttggtgattaacttgacgccagacaagcagcacaccagtgtggtcaatgcggtgatgcctctgatgaagcaaggtgctgccttgggttactcacacggttttaatatcgttgaagagggcatgcagatccgtaaagacatcacggttgtgatggtggcaccaaaatgtccgggtacggaagttcgtgaagagtataagcgcggtttcggcgttcctactcttatcgcggtacaccctgaaaacgatccacaaggtgaaggttgggaaattgctaaagcgtgggctgcggcaacgggtggccatcgtgcgggctgtttagcttcttcttttgtggcggaagtgaaatccgatttgatgggtgagcaaaccattctctgcggtatgctgcaagcgggctctatcgtttgttacgagaaaatggttgctgatggcatcgaccctggttatgcgggcaagcttttgcaatttggttgggaaaccattaccgaagcactcaagtttggcggtattactcatatgatggatcgcctgtctaaccctgcaaaaatcaaagcgtttgagctgtctgaagagttgaaagatctgatgcgcccactgtacaacaagcatatggatgacatcatttctggccacttctctagcaccatgatggcggattgggcgaatgatgataaagacttattcggctggcgtgcagaaaccgctgagacgacctttgaaaactatccaacaaccgacgtaaaaattgctgagcaagaatactttgataacggtattttgatgattgccatggtgcgtgctggggttgagttggcgtttgaagcgatgacggcttcaggcatcatcgatgagtcggcttactatgaatcactgcacgaactcccactgattgccaatacggtagcgcgtaagcgtctgtatgaaatgaacgtggtaatctctgacactgctgagtacggtaactatctgtttgccaatgtggcggtaccactattgcgtgaaaagtttatgccgaaagtgggcactgatgtgattggtaaaggattaggcgtggtctctaatcaagttgataacgcaacgcttatcgaagtaaacagcatcatccgtaaccatccggttgagtatatcggtgaagagctacgcggttacatgaaagacatgaagcgcatcgccgtgggtgattaa

SEQ ID NO: 518 - protein, 494 aa, Vibrio cholerae
MANYFNTLNLREQLDQLGRCRFMAREEFATEADYLKGKKVVIVGCGAQGLNQGLNMRDSGLDVSYALRQAAIDEQRQSFKNAKNNGFNVGSYEQLIPTADLVINLTPDKQHTSVVNAVMPLMKQGAALGYSHGFNIVEEGMQIRKDITVVMVAPKCPGTEVREEYKRGFGVPTLIAVHPENDPQGEGWEIAKAWAAATGGHRAGCLASSFVAEVKSDLMGEQTILCGMLQAGSIVCYEKMVADGIDPGYAGKLLQFGWETITEALKFGGITHMMDRLSNPAKIKAFELSEELKDLMRPLYNKHMDDIISGHFSSTMMADWANDDKDLFGWRAETAETTFENYPTTDVKIAEQEYFDNGILMIAMVRAGVELAFEAMTASGIIDESAYYESLHELPLIANTVARKRLYEMNVVISDTAEYGNYLFANVAVPLLREKFMPKVGTDVIGKGLGVVSNQVDNATLIEVNSIIRNHPVEYIGEELRGYMKDMKRIAVGD

SEQ ID NO: 519 - DNA, 1014 bp, Pseudomonas  fluorescens
atgaaagttttctacgataaagactgcgacctgtcgatcatccaaggtaagaaagttgccatcatcggctacggttcccagggccacgctcaagcatgcaacctgaaggattccggcgtagacgtgactgttggcctgcgtaaaggctcggctaccgttgccaaggctgaagcccacggcttgaaagtgaccgacgttgctgcagccgttgccggtgccgacttggtcatgatcctgaccccggacgagttccagtcccagctgtacaagaacgaaatcgagccgaacatcaagaagggcgccactctggccttctcccacggcttcgcgatccactacaaccaggttgtgcctcgtgccgacctcgacgtgatcatgatcgcgccgaaggctccaggccacaccgtacgttccgagttcgtcaagggcggtggtattcctgacctgatcgcgatctaccaggacgcttccggcaacgccaagaacgttgccctgtcctacgccgcaggcgtgggcggcggccgtaccggcatcatcgaaaccaccttcaaggacgagactgaaaccgacctgttcggtgagcaggctgttctgtgtggcggtaccgtcgagctggtcaaagccggtttcgaaaccctggttgaagctggctacgctccagaaatggcctacttcgagtgcctgcacgaactgaagctgatcgttgacctcatgtacgaaggcggtatcgccaacatgaactactcgatctccaacaacgctgaatacggcgagtacgtgactggtccagaagtcatcaacgccgaatcccgtcaggccatgcgcaatgctctgaagcgcatccaggacggcgaatacgcgaagatgttcatcagcgaaggcgctaccggctacccatcgatgaccgccaagcgtcgtaacaacgctgctcacggtatcgaaatcatcggcgagcaactgcgctcgatgatgccttggatcggtgccaacaaaatcgtcgacaaagccaagaac

SEQ ID NO: 520 - protein, 338 aa, Pseudomonas  fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 521 - DNA, 1047 bp, Achromobacter xylosoxidans
atgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctga

SEQ ID NO: 522 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 523 - DNA, 1014 bp, Pseudomonas  aeruginosa
atgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggcaccgggtcacaccgtgcgttccgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaggccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaatgccgaatacggtgagtacgtaaccggtccggaggtgatcaacgccgagtcccgtgctgccatgcgcaacgccctgaagcgcatccaggacggcgagtacgcgaaaatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaac

SEQ ID NO: 524 - protein, 338 aa, Pseudomonas  aeruginosa
MRVFYDKDCDLSIIQGKKVAIIGYGSQGHAHACNLKDSGVDVTVGLRSGSATVAKAEAHGLKVADVKTAVAAADVVMILTPDEFQGRLYKEEIEPNLKKGATLAFAHGFSIHYNQVVPRADLDVIMIAPKAPGHTVRSEFVKGGGIPDLIAIYQDASGNAKNVALSYACGVGGGRTGIIETTFKDETETDLFGEQAVLCGGCVELVKAGFETLVEAGYAPEMAYFECLHELKLIVDLMYEGGIANMNYSISNNAEYGEYVTGPEVINAESRAAMRNALKRIQDGEYAKMFITEGAANYPSMTAYRRNNAAHPIEQIGEKLRAMMPWIAANKIVDKSKN

SEQ ID NO: 525 - DNA, 1851 bp, Escherichia coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 526 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 527 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 528 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 529 - DNA, 1836 bp, Agrobacterium tumefaciens
atgccagcctatcgctccagaacgacaacccacggccgcaacatggcgggcgcgcgcggcctttggcgcgccaccggcatgaaggacagcgatttcggcaagccgatcatcgcggtggtcaattccttcacgcagttcgtaccgggccatgtgcatctaaaggatctcggccagctcgttgcccgcgaaatcgaggcggccggcggcgttgccaaggaattcaacacgattgcggtcgatgatggtatcgccatgggccatgacggcatgctctattcgctgccgtcgcgcgagatcatcgctgactcggtcgaatatatggtcaatgcccattgcgccgatgcgatggtctgcatttccaactgcgacaagatcacgcccggcatgctgaatgccgcgatgcgcctcaacattcccgccgttttcgtgtccggtggtccaatggaagcgggcaaggtggttctgcacggcaagaccgttgcgctcgatctggtcgacgcgatggtggctgctgccgacgacaagatttccgatgaggacgtcaagatcatcgagcgctccgcctgcccgacctgcggttcctgttccggcatgttcacggccaattccatgaactgtctgaccgaggcgctcggcctgtcattgcccggcaacggctcgacgcttgccacccactccgatcgcaagcgcctgttcgttgaagccggtcacctgatcgtcgatctggcccgccgttattacgagcaggacgacgaaaccgttctgccgcgcaccatcgccaacaaggcggcgttcgaaaacgccatgtcgctggatattgccatgggcggctccaccaacacggttctgcatattctggcggcagcccacgagggcggcgtcgatttcggtatggaggacatcgaccggctttcccgcaaggttccctgcctttccaaggttgcgcctgcgaagcaggatgtgcacatggaagacgtgcatcgcgccggcggcatcatgcgtattctcggtgagctggagcgtggcggtctcatcaaccgcgatacctataccgtacacgaagcgacgcttggcgatgccatcgaccgctgggacatcacgcgcaccaacagcgaaatggtgcggcagttcttcaaggccgctccgggcggcgtaccgacacaggtggccttcagccagtcctcgcgctgggatgatctggacaccgacagcgacaacggcgtcattcgttcggtcgagaagcctttctccaaggatggcggtctggccgttctttacggcaacatcgcgctcgatggctgcatcgtgaagacggcgggtgttgatgaatccatcctgaaattcaacggatcggcagtcgtttacgaaagccaggacgcggccgtgaagggcattctcggcaacgaggtcaaggcgggcgacgtcgtcgtcatccgctatgaaggaccgaagggcggcccgggcatgcaggaaatgctctatccgaccagctacctcaagtccaagggcctcggtaaagcctgcgcgctcatcaccgatggtcgcttctccggtggcacgtcaggcctttccatcggtcatgcctcgccggaagcggcgcagggcggtgccatcggcctcgtgcgtcagggcgacctgattgagatcgatattccgaaccgcacgatcaatctcaaggtttcggatgcggaactggccgcgcgccgggccgagcaggaagaaaagggctggaagccggaagcaccgcgcaagcgtaatgtcacgacggcgctcaaggcctatgcggcctttgcgtcgagcgcggacaagggtgctgtgcggattctgccggagtaa

SEQ ID NO: 530 - protein, 611 aa, Agrobacterium tumefaciens
MPAYRSRTTTHGRNMAGARGLWRATGMKDSDFGKPIIAVVNSFTQFVPGHVHLKDLGQLVAREIEAAGGVAKEFNTIAVDDGIAMGHDGMLYSLPSREIIADSVEYMVNAHCADAMVCISNCDKITPGMLNAAMRLNIPAVFVSGGPMEAGKVVLHGKTVALDLVDAMVAAADDKISDEDVKIIERSACPTCGSCSGMFTANSMNCLTEALGLSLPGNGSTLATHSDRKRLFVEAGHLIVDLARRYYEQDDETVLPRTIANKAAFENAMSLDIAMGGSTNTVLHILAAAHEGGVDFGMEDIDRLSRKVPCLSKVAPAKQDVHMEDVHRAGGIMRILGELERGGLINRDTYTVHEATLGDAIDRWDITRTNSEMVRQFFKAAPGGVPTQVAFSQSSRWDDLDTDSDNGVIRSVEKPFSKDGGLAVLYGNIALDGCIVKTAGVDESILKFNGSAVVYESQDAAVKGILGNEVKAGDVVVIRYEGPKGGPGMQEMLYPTSYLKSKGLGKACALITDGRFSGGTSGLSIGHASPEAAQGGAIGLVRQGDLIEIDIPNRTINLKVSDAELAARRAEQEEKGWKPEAPRKRNVTTALKAYAAFASSADKGAVRILPE

SEQ ID NO: 531 - DNA, 1902 bp, Burkholderia cenocepacia
gtgcctccacccttttcccgcgatatttcttcagccatcaccatgcccacttaccgttccaaaacctccaccgccggccgcaacatggcaggtgcgcgctcgctgtggcgcgccaccggcatgaaagacgacgatttctcgaaaccgatcatcgcggtcgtcaactcgttcacgcaattcgtgcccgggcacgtgcacctgaaggatctcggccagctcgtcgcgcgcgagatcgaggctgccggcggcgtcgcgaaggaattcaacacgatcgcggtcgacgacggcatcgcgatgggccacgacggcatgctgtactcgctgccgagccgcgacatcatcgccgactcggtcgaatacatggtgaacgcgcactgcgcggacgcgatggtgtgcatctcgaactgcgacaagatcacgccggggatgctgatggccgcgatgcgcctgaacattccggtgatcttcgtgtcgggcggcccgatggaagccggcaagacgcgcctcgcgaacccggtcaccaagaccgtcgaactgaagaagctcgacctcgtcgacgcgatggtgatcgcggccgaccagtcgtattcggacgccgacgtcgccgaagtcgaacgctcggcctgcccgacctgcggctcgtgctcgggcatgttcaccgcgaactcgatgaactgcctgaccgaagcgctcggcctgtcgctgcccggcaacggtacggtggtcgccacgcacgccgatcgcgaacagctgttcaagcgcgccggccgccgcatcgtcgaactgacgcgccagcactacgagcaggacgacgaacgcgtgctgccgcgctcggtcggcttcaaggcgttcgagaacgcgatgacgctcgacatcgcgatgggcggctcgaccaacacgatcctgcacctgctcgcgatcgcgcaggaagccggcatcgacttcacgatgaaggacatcgaccgcctgtcgcgcaccgtgccgcagctgtgcaaggtcgcgccgaacacgaacaagtaccacatcgaggacgtgcaccgcgccggcggcatcatggcgatcctcggcgagctcgagcgcgccggcaagctgcacaccgacgtgccgaccgtccatgcgccgacgctgaaggatgcgctcgaccagtgggacatcgtcctcacgcaggacgaagcggtccgcaggttctacctggccggcccggccggcatcccgacgcaggtcgcgttcagccagaacacgcgctggccgagcctcgacctcgaccgcgccgaaggctgcatccgctcgtacgagcatgcgttctcgaaggaaggcggcctcgcggtgctgacgggcaacatcgcgctcgacggctgcgtggtgaagacggccggcgtcgacgaaagcatcctcgttttcgaaggctcggcgcacgtgaccgaatcgcaggacgaagcggtcgagaacatcctcaacgacaaggtcaaggccggcgacgtggtgatcgtgcgctacgaaggcccgaagggcggcccgggcatgcaggaaatgctctacccgaccagctacatcaagtcgaaagggctcggcaaggcgtgtgcgctgctgacggacggccggttctcgggtggtacgtcggggctgtcgatcggccattgctcgccggaagcggcggcaggcggcgcgatcggcctcgtgcgcgacggcgaccggatccgcatcgacattccgaaccgcacgatcgacgtgctggtgtcggacgaggaactggcgcgccgccgcgaggagcagaacgcgaagggctggaagcctgcgcagccgcgtccgcgcaaggtgtccgcggcgctcaaggcgtacgcgaagctcgtcatgtcggccgacaagggcgccgtgcgcgatctgtcgctgctcgacgactga

SEQ ID NO: 532 - protein, 633 aa, Burkholderia cenocepacia
MPPPFSRDISSAITMPTYRSKTSTAGRNMAGARSLWRATGMKDDDFSKPIIAVVNSFTQFVPGHVHLKDLGQLVAREIEAAGGVAKEFNTIAVDDGIAMGHDGMLYSLPSRDIIADSVEYMVNAHCADAMVCISNCDKITPGMLMAAMRLNIPVIFVSGGPMEAGKTRLANPVTKTVELKKLDLVDAMVIAADQSYSDADVAEVERSACPTCGSCSGMFTANSMNCLTEALGLSLPGNGTVVATHADREQLFKRAGRRIVELTRQHYEQDDERVLPRSVGFKAFENAMTLDIAMGGSTNTILHLLAIAQEAGIDFTMKDIDRLSRTVPQLCKVAPNTNKYHIEDVHRAGGIMAILGELERAGKLHTDVPTVHAPTLKDALDQWDIVLTQDEAVRRFYLAGPAGIPTQVAFSQNTRWPSLDLDRAEGCIRSYEHAFSKEGGLAVLTGNIALDGCVVKTAGVDESILVFEGSAHVTESQDEAVENILNDKVKAGDVVIVRYEGPKGGPGMQEMLYPTSYIKSKGLGKACALLTDGRFSGGTSGLSIGHCSPEAAAGGAIGLVRDGDRIRIDIPNRTIDVLVSDEELARRREEQNAKGWKPAQPRPRKVSAALKAYAKLVMSADKGAVRDLSLLDD

SEQ ID NO: 533 - DNA, 1911 bp, Psychrobacter cryohalolentis
atggattacaattcaaaaacctctaccggcggtcgtaatatggcaggtgctcgtgccctgtggcgcgcaactggcatgactgatggcgactttggcaaacctattattgcaattgccaactcttttacccagtttgtacccggccatgtgcatttaaaagatttgggacaaatggttgcacgcgagattgaaaaagcgggtggcgtggcaaaagaatttaataccattgctgttgatgatggtattgccatgggtcatagcggcatgttgtattcactaccgagtcgagatttgattgctgattctgtcgagtatatggtcaatgcccactgcgccgatgcgctagtatgtatttctaactgcgataaaatcactccgggtatgttgatggcagccatgcgcctcaatatccccgtcgtctttatttcaggtggcccaatggaagcgggtaaaattatcgccagcacggtcgcacacagtcataataatgatggtagtagcgacgtccatagcactgacagtaaaggtaatgccattcgtaagcttgacctcgttgatgcgatgatggacgcggccgatgatagcattagtgatgaagatgtcgctgctattgaggcctcagcgtgcccgacttgtgggtcgtgctctggcatgttcactgccaactcgatgaattgcttgaccgaagcattaggattggcattaccgggtaatggctcgctattggcaacccattcgctacgtcgcgagctattcctagaagcgggtcgtactatcgtgtcactagccaaacgtcgctacgagcaagatgatgattcagtcctaccgcgctctatcgctactaaagccgcgtttgaaaatgccatgactttagacatcgccatgggcggctctaccaatactattttgcatttgcttgctgctgcacatgaagccgaagtcgacttcaaaatgcacgatattgaccgtttaagtcgtggcgtcccttgtttggctaaagttgcccctgcttcacaaaagtatcatatggaagatgtgcatcgtgctggtggtgtctttgcgctattggccgagcttgaccgtgctggtttgctgcataccgatttgccaactatccatagtgccacgatgaaagaagcgattgataaatgggatattatgaatcctgacaatcttgaagcacgtgcacgctatattgcagcccctggtggcgtacggacgactgaggctttctcacaatcaaaagaatggtcaaatctggatgtgaaccgagagtcaggctgtatccgaagtgcccaacatgcttattcaactgatggcggtcttgccgttctatacggaaacattgctgagcgtggctgtgtggtcaaaactgccggcgttgatgacagcatcttggttttcaccggacgtgcacgcatctttgaatcacaagatgatgcagtagcagcggtgcttgatgatcaaatcgtcgcaggcgatgtagttatcatccgttttgagggtccaaaaggcggtcctggtatgcaagagatgctctacccgacgacttatctaaaatctaaaggcctaggcaaagaatgtgcgctgcttacagatggtcgcttctctggtgggacatcaggcttgtctattggtcatgccagcccagaagccgctgaaggcggcgccattggcctagtgcaagaaggcgatactatccatattgatatcccaaaccgtaccatcaatatgcaggtcagtgatgaagagttagctgctcgccgcgaagaaatggaaagtcgtggacgtgatgcttggaaacccgttagccgtgagcgtcatgtctctcctgctttacgtgcctatgctgcaatgaccaccagtgccgatacgggcgctgtacgtgacgtcagccaagttgaacgttag

SEQ ID NO: 534 - protein, 636 aa, Psychrobacter cryohalolentis
MDYNSKTSTGGRNMAGARALWRATGMTDGDFGKPIIAIANSFTQFVPGHVHLKDLGQMVAREIEKAGGVAKEFNTIAVDDGIAMGHSGMLYSLPSRDLIADSVEYMVNAHCADALVCISNCDKITPGMLMAAMRLNIPVVFISGGPMEAGKIIASTVAHSHNNDGSSDVHSTDSKGNAIRKLDLVDAMMDAADDSISDEDVAAIEASACPTCGSCSGMFTANSMNCLTEALGLALPGNGSLLATHSLRRELFLEAGRTIVSLAKRRYEQDDDSVLPRSIATKAAFENAMTLDIAMGGSTNTILHLLAAAHEAEVDFKMHDIDRLSRGVPCLAKVAPASQKYHMEDVHRAGGVFALLAELDRAGLLHTDLPTIHSATMKEAIDKWDIMNPDNLEARARYIAAPGGVRTTEAFSQSKEWSNLDVNRESGCIRSAQHAYSTDGGLAVLYGNIAERGCVVKTAGVDDSILVFTGRARIFESQDDAVAAVLDDQIVAGDVVIIRFEGPKGGPGMQEMLYPTTYLKSKGLGKECALLTDGRFSGGTSGLSIGHASPEAAEGGAIGLVQEGDTIHIDIPNRTINMQVSDEELAARREEMESRGRDAWKPVSRERHVSPALRAYAAMTTSADTGAVRDVSQVER

SEQ ID NO: 535 - DNA, 1851 bp, Psychromonas sp.
atgcccaaattacgttcagcaactagtacagaaggccgaaacatggcaggcgcgcgtgcattgtggcgcgccactggcgtcaaagataatgattttggaaaacctattattgccattgcgaattcatttacccaatttgttcctgggcatgtacatcttaaaaacatgggtgatttagtggcgggtgcgattgctgaggcgggcggtatctctaaagaatttaataccattgcggttgatgacggcattgcgatgggccattcaggtatgctttatagtttaccttcacgtgacctgattgctgatagtgttgaatatatggtaaatgcacattgtgcggatgctttagtgtgtatttcaaattgtgacaagatcacgccggggatgttgatggcggcattacgccttaatattccggttgtttttgtctcaggtggcccgatggaagcgggtaaaaccaagctttcagataaaattattaagttagatttggtcgatgccatggtggcgggcgcagacgacaggatctccgacgctgacagtgcacaaattgagcgcagtgcttgcccaacgtgtggctcttgctctggtatgtttaccgctaactccatgaactgtctaacggaagtcttagggttatcactacccggtaatggcactatgcttgcaacgcacgcagacagacgcgctcttttcttagaagcgggaaagtgcattgtggcattaacgaaacgttattatgacgatgacgatgagtctgttttaccgcgtaatattgccaattttaaagcctttgaaaacgccatgacacttgatattgcgatgggaggctcaagtaatacggtgctgcatttattagctgctgcccaagaagcgcatattgattttaacatggatgatattgatagaatttcacgcttagtgcctcatttgtgcaaagttgccccctctacacctaaatatcatatggaagatgtgcaccgcgcaggtggggtaatgggtattttaggcgaattggacagagccggccttattcataatgacgctaatcatgtggcgggcagtagtttaaaagcggtattagagaaatgggatattgtgcaaactaaagaggcgagtgtgcgtgatttttaccgcgcaggtccgggaggtattccaactcagcaagcttttagtcaggatagtcgctgggatagtgtggatgatgacaggcagaatggctgtattcgtaaacgtgaatttgcgtttagccaagaaggcggacttgccgtgctggcgggtaatattgcgccaaagggctgtattgttaaaacggcgggggtcgatgaagaagagcatcaatttaccggtacggcgcgcgtgtttgagagccaagatgatgcagtgagcgccatcttagcgggaaaagtgattgcgggtgatgtggttgtcattcgttatgaaggccccaaaggtggccccggcatgcaagaaatgttgtatcccaccagttatttaaaatcacgtgggttaggtaaatcatgtgccttaataaccgacggacgattttcgggtggaacctcgggcttatcgattgggcatatttctccagaggctgcagcgggcggtaatattgccttgattgagacgggtgatgttatcaaaattgatattcctgcacgcagtattcaccttgatattagtgatgaagagctcaagttacgccataaaaatatgctagcgcgcggtaaacttgcttggaaacccgtttcgagaaaacgtattgtgccactcgcgcttaaagcttacgctttgctggtgaccagtgcagataaaggggcggttcgtgacgcttcaatgttggaggattaa

SEQ ID NO: 536 - protein, 616 aa, Psychromonas sp.
MPKLRSATSTEGRNMAGARALWRATGVKDNDFGKPIIAIANSFTQFVPGHVHLKNMGDLVAGAIAEAGGISKEFNTIAVDDGIAMGHSGMLYSLPSRDLIADSVEYMVNAHCADALVCISNCDKITPGMLMAALRLNIPVVFVSGGPMEAGKTKLSDKIIKLDLVDAMVAGADDRISDADSAQIERSACPTCGSCSGMFTANSMNCLTEVLGLSLPGNGTMLATHADRRALFLEAGKCIVALTKRYYDDDDESVLPRNIANFKAFENAMTLDIAMGGSSNTVLHLLAAAQEAHIDFNMDDIDRISRLVPHLCKVAPSTPKYHMEDVHRAGGVMGILGELDRAGLIHNDANHVAGSSLKAVLEKWDIVQTKEASVRDFYRAGPGGIPTQQAFSQDSRWDSVDDDRQNGCIRKREFAFSQEGGLAVLAGNIAPKGCIVKTAGVDEEEHQFTGTARVFESQDDAVSAILAGKVIAGDVVVIRYEGPKGGPGMQEMLYPTSYLKSRGLGKSCALITDGRFSGGTSGLSIGHISPEAAAGGNIALIETGDVIKIDIPARSIHLDISDEELKLRHKNMLARGKLAWKPVSRKRIVPLALKAYALLVTSADKGAVRDASMLED

SEQ ID NO: 537 - DNA, 1824 bp, Deinococcus radiodurans
atgccgacttaccgttccagaaccaccaccgagggccgtaatatggccggcgcccgtgccctgtggcgcgccaccggcatgaccgacggcgatttccagaagccgatcatcgcggtggtcaactcgttcacccagttcgtgccggggcacgtgcacctcaaggacctcgggcaactcgtcgcgggtgaaatcgcggcggcgggcggcgtggcgaaggagttcaacaccatcgccgtggacgacggcatcgccatgggccacgacgggatgctctactcactgcccagccgcgaaatcatcgccgacagcgtggagtacatggtcaacgcccactgcgccgacgcgatggtttgcatctccaactgcgacaagattacccccggcatgctgatggccgcgctgcgcctcaatatccccaccgtgttcgtctcgggcgggccgatggaagcgggcaaggtcaagctcggtgacggcgagcacgcgctggacctggtggacgcaatggtgatggccgccgacgacagcgtgagcgaggaagacatcgaactggtggagcgctcggcctgccccacctgcggctcgtgctcgggcatgttcaccgccaactcgatgaactgcctgacggaggcgctgggcctctcgctgccgggcaacggctcggtgctggcgacccactccgaccgccagaacctgttcaagcgcgccgggcacctgatcgtggacctcgccaagcgctactacgagggcgatgacgagagcgtgctgccgcgcagtgtcgccacctacgacgccttcgagaacgccatgaccctcgacatctcgatgggcggctcgaccaatacggtgctgcacctgctggccgccgcgcacgaggccggggtggatttcaccatgcaggacatcgaccagctctcgcggcgggtgccggtgctgtgcaaggtggcgcccgccaagaacgacgtgcacatggaagacgtgcaccgcgctgggggcatcatgggcattctgggcgagcttgaccgcgccgggctgctgaagaccgacgtgagcaccgtacacgcccccagcatgagcgccgccctgaacgagtgggacgtggtccgcaatgagaaccaccacgagttctaccgcgccgcgcccggcggcattcccaccgtcttcgccttctcgcagtcgcgccgttaccgcgaactcgacaccgaccgggaagcaggcgtcattcgcagcgccgagcacgctttctcgcaggacggcgggctggcggtgctgtacggcaacctcgccgaagacggctgcatcgtcaagacggcgggcgtggacgaatccatcctgaagttcagcggcccggcgcgcgttttcgagtcgcaagacgcctcggtggacgccatcctcagcggcgaagtcaaggaaggcgaggtcgtgctgattcgctacgaaggcccacgcggtggccccggcatgcaggaaatgctctacccgacgagctacctcaagtccaaggggctgggcaaagcctgcgcgctggtcaccgacggtcgtttctcgggcggcagcagcggcctgagcatcggccacgtctcgcccgaggcggcggagggcggcaccatcggcctggtcgagacgggcgacctcatcgaaatcgacatcccgaaccgcaccattcacctcgccgtgccggacgctgaactcgccgcccgccgccagaagcgcgaggaagaaggctggcaccccgccgaaccccggccccgcaaaatcaccgctgccctacgcgcctatgcgtctatgacgacgagcgcttcgcggggcgcggtgcggaatatctga

SEQ ID NO: 538 - protein, 607 aa, Deinococcus radiodurans
MPTYRSRTTTEGRNMAGARALWRATGMTDGDFQKPIIAVVNSFTQFVPGHVHLKDLGQLVAGEIAAAGGVAKEFNTIAVDDGIAMGHDGMLYSLPSREIIADSVEYMVNAHCADAMVCISNCDKITPGMLMAALRLNIPTVFVSGGPMEAGKVKLGDGEHALDLVDAMVMAADDSVSEEDIELVERSACPTCGSCSGMFTANSMNCLTEALGLSLPGNGSVLATHSDRQNLFKRAGHLIVDLAKRYYEGDDESVLPRSVATYDAFENAMTLDISMGGSTNTVLHLLAAAHEAGVDFTMQDIDQLSRRVPVLCKVAPAKNDVHMEDVHRAGGIMGILGELDRAGLLKTDVSTVHAPSMSAALNEWDVVRNENHHEFYRAAPGGIPTVFAFSQSRRYRELDTDREAGVIRSAEHAFSQDGGLAVLYGNLAEDGCIVKTAGVDESILKFSGPARVFESQDASVDAILSGEVKEGEVVLIRYEGPRGGPGMQEMLYPTSYLKSKGLGKACALVTDGRFSGGSSGLSIGHVSPEAAEGGTIGLVETGDLIEIDIPNRTIHLAVPDAELAARRQKREEEGWHPAEPRPRKITAALRAYASMTTSASRGAVRNI

SEQ ID NO: 539 - DNA, 1680 bp, Wolinella succinogenes
atgagaagtagcatcattaaagaggggtatcaaaaggcgccacaccgaagcttgctgagggcaacggggctcaaagacgaggattttggtaagccattcattggcgtggccaacagctatattgacatcattccgggtcactttttcttgcaagagtatggccgaatcattaaagaggagattagggccgcgggcggaatcccttttgagtttaacactatcggggtggatgatggaatcgccatggggcatgatggaatgctctatagtttgcccagtcgagagctgattgctgattgtattgagacggtgatgaatgcccataaactggacgccatgatctgtatccctaattgcgacaagattgtccctgggatgcttctgggggcactcagagtgaatgtgcccacggtgtttgtgagtggcggaccgatgaaggcaggtcgcctcaaggatggcaccaaagtggatttggcgagtgcttttgaggcggtgggtaaacgcgcgaggaatcagattagcgatgaagagctccgcgagattgagtgcgccgcctgtccggggggaggaagctgcagtggaatgttcacggcgaactccatgaacacactctgtgaagcgatgggagtggcgcttcccgggaatgggacgattccagccctcaccaaagagcgtgaggagctcatccgaaaagccgcaagaagaatcgtagaaatcgcactagatgagcgctacgccttccgcaatattctcaacaaagaggcgattcacaatgcttttgttgtggatatggcgatggggggaagcaccaataccgtacttcatatgatggccattgccaaagagagagaggcggattttgatttgcgcaaaatcaatgagatcgccaaagaggtgagtcatatcgccaaaatctcccctgcactctacactgtccacatggaagacatcaatagagccgggggcgtgaatgcggtcatgaatgagatcaatcgccgaggcggagtgctcaagacagaggcgctcaccgtgagtggcgagagcatgggtgagaggatcgcgggggcgaagattttagatacgcaaatcattcacacgcttgagaatccctatagcgcggtggggggattgaagattctttatggaaatcttgccgagcagggcgctgtgctcaagaccgctgccatggacgctaagatgagaaaattcactggaaaggcagtctgctttgattctcaagaggaggcgatcgcaggtattgtcgggggcaaggtcaaagagggggatgtggtggtgatccgctacgaaggacccaaggggggaccgggaatgcaggagatgctaagtcccacaagcctcatcatggggatgaatttaggagacaaagtcgcgctcattaccgatggccgtttcagcggcgccacgcgtggcgcttgcatcgggcatgtgagtcccgaagcggccgaagggggaatgatcggactgcttcaagagggcgatcttattcgaatcgatgtcgaagaaggggttttggaggtgttgcttgaggaggcggagatccaaaagcgacgcgcctcctttagtcctaaaactaaaaccgttgcctccaagtggctcaaacgctaccagcttctcgtgagcaatgccgcttcaggcgctattttgaaaacggagctataa

SEQ ID NO: 540 - protein, 559 aa, Wolinella succinogenes
MRSSIIKEGYQKAPHRSLLRATGLKDEDFGKPFIGVANSYIDIIPGHFFLQEYGRIIKEEIRAAGGIPFEFNTIGVDDGIAMGHDGMLYSLPSRELIADCIETVMNAHKLDAMICIPNCDKIVPGMLLGALRVNVPTVFVSGGPMKAGRLKDGTKVDLASAFEAVGKRARNQISDEELREIECAACPGGGSCSGMFTANSMNTLCEAMGVALPGNGTIPALTKEREELIRKAARRIVEIALDERYAFRNILNKEAIHNAFVVDMAMGGSTNTVLHMMAIAKEREADFDLRKINEIAKEVSHIAKISPALYTVHMEDINRAGGVNAVMNEINRRGGVLKTEALTVSGESMGERIAGAKILDTQIIHTLENPYSAVGGLKILYGNLAEQGAVLKTAAMDAKMRKFTGKAVCFDSQEEAIAGIVGGKVKEGDVVVIRYEGPKGGPGMQEMLSPTSLIMGMNLGDKVALITDGRFSGATRGACIGHVSPEAAEGGMIGLLQEGDLIRIDVEEGVLEVLLEEAEIQKRRASFSPKTKTVASKWLKRYQLLVSNAASGAILKTEL

SEQ ID NO: 541 - DNA, 1857 bp, Zymomonas mobilis
atgcctccctatcgttccagaaccacgactcatggtcgtaatatggcgggtgccagaagtttatggcgcgcaaccggcgtcaaaaatgaagattttggtaagccgattatcgctgttgccaacagctttacgcaatttgtccccggtcatgtccatttaaaggatatgggacagcttgttgctgaagaaattgaaaaagctggcggtatcgccaaagaattcaatacgattgcgattgatgatggtatcgcgatgggacatggcgggatgctttattccttgccgtctcgggaattgattgccgattccgtcgaatatatggtcaacgcccattgtgctgatgctttggtctgtatttccaactgcgacaagattacgcctggtatgttgatggcttcgatgcgcctgaatatcccgacagttttcgtctctggtggacctatggaagccggtaaagccgaggtcaaaggcgtcaagcgggcgcttgatctgatcgatgctatggtgattgctgccgatgaccattacagcgatggtgaagtcgaagttatcgagcagacggcttgcgctacctgcggttcctgttccggtatgtttacggccaattcgatgaattgcctgaccgaggccttggggctttctttcccaggtaatggttcgatgcttgcgacccatagcgatcgggaacagcttttccgcaaggctgggcataccattgttgatatggcgcgcagctattatgagcaggatgatgccgctgtattaccgcgttcaattgccacgcttgaggcttttgaaaatgcgatgagtcttgatatcgccatgggtggttccaccaatacggttttgcatctgttggcggtcgcgcaggaaggcaacgtgcctttcactatggcggatattgatcgtctttcccgtcatgtcccttgcttatgcaaggtcgcaccggccaaaaatgatgtccatatggaagatgttcatcgggcagggggcgttatggccattttaggccagcttgatcgtgccggattgatcaataccagcttgcgcaccattcattctccgactttaggcgcagcattggacgcatgggatatcagccgtgacagttgttctgaagaagcgcagttattctatcgcgcggctccggggggtgttccgactcaaaaggctttcagccagtcttctcgctatgaagcgctggatactgaccgcgaaaaaggtgtgattcgttctaaaaatcatgctttttcgacggatggtggtctggccgtcttatttggcaatcttgctcctgaaggcagtattgtcaaaactgccggtgtggatgagtctattctgaaattcaccggtaaagccaaggtttacgaaagtcaggaagccgccgttgccggtattcttggcaatgatgtcgaagctggtgaagtggtgatcgttcgctatgaaggtcccaaaggtggccccggtatgcaggaaatgctgtatccgaccagctatctgaaatcgaaaggtttgggtaaactctgcgctctgattaccgatggtcgtttttctggtggtagctctggtttatccatcggccatgtttctcctgaagcggccgagggcggcttgatcgctttggtcgaaaccggtgatacaattgttatcgatattcctgaacggattatccatctggatgttgatgatgctgttattgccgatcgtcatgcccgcatggaagccaagggggcggcagcatggaaaccgcaaaaccgtaatcgtccgatttcttcggctttgaaagcctatgcagctttgacgacaaacgctgcccgtggggcagttcgagatgtcaatcagctcgaacggcgttaa

SEQ ID NO: 542 - protein, 618 aa, Zymomonas mobilis
MPPYRSRTTTHGRNMAGARSLWRATGVKNEDFGKPIIAVANSFTQFVPGHVHLKDMGQLVAEEIEKAGGIAKEFNTIAIDDGIAMGHGGMLYSLPSRELIADSVEYMVNAHCADALVCISNCDKITPGMLMASMRLNIPTVFVSGGPMEAGKAEVKGVKRALDLIDAMVIAADDHYSDGEVEVIEQTACATCGSCSGMFTANSMNCLTEALGLSFPGNGSMLATHSDREQLFRKAGHTIVDMARSYYEQDDAAVLPRSIATLEAFENAMSLDIAMGGSTNTVLHLLAVAQEGNVPFTMADIDRLSRHVPCLCKVAPAKNDVHMEDVHRAGGVMAILGQLDRAGLINTSLRTIHSPTLGAALDAWDISRDSCSEEAQLFYRAAPGGVPTQKAFSQSSRYEALDTDREKGVIRSKNHAFSTDGGLAVLFGNLAPEGSIVKTAGVDESILKFTGKAKVYESQEAAVAGILGNDVEAGEVVIVRYEGPKGGPGMQEMLYPTSYLKSKGLGKLCALITDGRFSGGSSGLSIGHVSPEAAEGGLIALVETGDTIVIDIPERIIHLDVDDAVIADRHARMEAKGAAAWKPQNRNRPISSALKAYAALTTNAARGAVRDVNQLERR

SEQ ID NO: 543 - DNA, 1659 bp, Clostridium acetobutylicum
gtgaattctgataaggcaatgaaaggagtagaaagagctccccacagatctctttttaaggctttaggttttatagatgaggaaatggatagacctcttataggaatagctaattcttacagcgaacttataccaggtcatatgaatcttgataaaatagttaaggctgtaaaagatggaataagaatggcaggaggtgttcctgtagaatttggaaccattggagtttgtgatggtatttctatgaatcataagggaatgagttattctcttccatcaagacagattatagcagatagtgttgagatcgtggctaaagcacatgctcttgatgggcttgtacttgtgccaaattgcgataaggtagttccaggaatgcttatggcggctggaagagttaacataccttcaatagtaataagtggaggaccaatgctttctggtagaacaaatggaagggtcacagatctaaactctgtattcgaagcagttggagcagtttcagcgggaaaaatgtctttagaagaattagctgagcttgagaatacggcatgccctacttgtgggtcttgttctggaatgtttacagcaaattcaatgaactgtctttctgaggttttaggtcttgcgcttccttacaatggaactataccagctgtattttcagaaagattaagacttgctaaaaaggcaggtatgaaaatagttgaattggttcaaaaggacataagaccaagtgacatacttacagaagctgcatttatgaatgcagtcgcaatggatatggcactagggggttctactaattcacttcttcatttaccagctatagcttatgaatgtgacgtggatattaatttcgataaaataaatgagataagtgaaaagattccgcatgtgtgtaagttaagtcctgcaggatttcatcacatagaggacttgcatatggcaggtggaataccggctgttgttaatggaattataaaaaaaggacttctaaatggagagtgtatgacagttacaggtaaaactttgtatgagaatgtgaaggatgcgaaaatcaaaaacattgatgtaataagaatagataatccttatagtgagacaggtggactttcagtattgagaggaaatttagctccagatggcgctatagttaaaaaggcagcagtagcacccgaaatgatgcagcatactggtccggctagggtatttaatagtgaagaggaagtttctaaggcaatacttggtggaaaaataaatccaggtgatgttgttgtgataaggtatgagggccctaagggtggaccaggaatgaaggaaatgctttcgccaacagcttcacttgcaggaatgggacttgataagagtgtggcgcttataactgatggaagattctcaggtgctacaagaggagcatccattggacatgtatctccagaagcggcagaaggtggtccaatagggttggttgaagagggagacacaattgaaatagatattgaaaagaaaactataaacctacttgttccggaagaaaaattaaaaaacagaaaaccggaaaaggttgaaaaacctgtgaagggatatttaaatacgtataggcagggggtatcatctgcttgtacaggagcagtttttcatagtacaaaggagtga

SEQ ID NO: 544 - protein, 552 aa, Clostridium acetobutylicum
MNSDKAMKGVERAPHRSLFKALGFIDEEMDRPLIGIANSYSELIPGHMNLDKIVKAVKDGIRMAGGVPVEFGTIGVCDGISMNHKGMSYSLPSRQIIADSVEIVAKAHALDGLVLVPNCDKVVPGMLMAAGRVNIPSIVISGGPMLSGRTNGRVTDLNSVFEAVGAVSAGKMSLEELAELENTACPTCGSCSGMFTANSMNCLSEVLGLALPYNGTIPAVFSERLRLAKKAGMKIVELVQKDIRPSDILTEAAFMNAVAMDMALGGSTNSLLHLPAIAYECDVDINFDKINEISEKIPHVCKLSPAGFHHIEDLHMAGGIPAVVNGIIKKGLLNGECMTVTGKTLYENVKDAKIKNIDVIRIDNPYSETGGLSVLRGNLAPDGAIVKKAAVAPEMMQHTGPARVFNSEEEVSKAILGGKINPGDVVVIRYEGPKGGPGMKEMLSPTASLAGMGLDKSVALITDGRFSGATRGASIGHVSPEAAEGGPIGLVEEGDTIEIDIEKKTINLLVPEEKLKNRKPEKVEKPVKGYLNTYRQGVSSACTGAVFHSTKE

SEQ ID NO: 545 - DNA, 1671 bp, Clostridium beijerinckii
atgagaagtgatgtaataacaaaaggatctaaaagtgcacctcaacgttcattgcttagtgccttaggtttaacaaaagaagaaatggaaaggcctcttgtaggtatcgtgagctcacaaaatgatatcgttcctggtcatatgaatttagacaaaatagttgaagctgtaaaaatgggagtttcaatggctggaggtactccaattgtctttcctgcaattgctgtttgtgacggtattgctatggggcatgaaggaatgaaatattcattagttacaagagatttaattgcagattctactgaagctatggcaatggctcatgcctttgatgcattagtaatggttcctaattgtgataaaaatgttcctggccttctaatggctgcagcaagagttaatattcctacaatttttgtaagtggcggaccaatgcttgccggaaaagttgacggatgtaagacaagcttatcaagtatgtttgaagctgttggcgcttacaatgctggaaaaattacagctgaaaaattagatgaatatgaaaacaacgtatgccctacttgtggttcttgttcaggaatgtatactgcaaatagtatgaactgtttaacggaagtacttggtatgggccttcaagggaatggtacaatccctgcagtttattcagaaagaataaaacttgcaaagcatgctggcatgaaaatcatggaattacttgaaaagaacataagaccaagagatattatgacagaagatgcatttatgaatgctatgactatggacatggctcttggctgtagtaccaatagtatgttgcatttacctgcaattgcacacgaagttggctttgatttaaatgttgatatagctaatgaaattagttcaaaaacaccgaatctttgccatcttgctcctgctggacacacttatattgaagatttaaatgatgctggtggaatttatgctgttatgaatgaaataaataagcttggtttattaaaaactaaccttataacatgtacaggaaaaactgttggtgaaaacattgaaggatgcataaataaaaatcctgaagttattagaccagtcaaaaatccatatagtcaaactggtgggattgcagttcttaaaggaaatctagcacctgattcatgtgtcgttaagcgttcagccgttgtaccaaaaatgttaaagcatgaaggtccagctaaagtgtttgattgcgaagaagatgcccttgaagcaataaatacaggaaaaattgttgctggagatgttgttgttatcagatatgaaggacctaaaggaggccctggcatgagagaaatgcttaatccaacttctgcaattgcaggaagaggtcttggaagttccgttgctcttataacagatggacgttttagtggcgctagcagaggtgcttcaatcgggcacgtttctccagaggcggcagtaggtggtaacatagcattagttgaggatggagatatgatccaaattgatattaacgctaacactattaacttcttagttagcgatgaagaattagcaagaagaaaagcaaattggaaaccaagaaaaccaaaaataactacaggttatctagcaagatacgctgctcttgttacatcaggaaatagaggtgctatcctagacatccctaaattttaa

SEQ ID NO: 546 - protein, 556 aa, Clostridium beijerinckii
MRSDVITKGSKSAPQRSLLSALGLTKEEMERPLVGIVSSQNDIVPGHMNLDKIVEAVKMGVSMAGGTPIVFPAIAVCDGIAMGHEGMKYSLVTRDLIADSTEAMAMAHAFDALVMVPNCDKNVPGLLMAAARVNIPTIFVSGGPMLAGKVDGCKTSLSSMFEAVGAYNAGKITAEKLDEYENNVCPTCGSCSGMYTANSMNCLTEVLGMGLQGNGTIPAVYSERIKLAKHAGMKIMELLEKNIRPRDIMTEDAFMNAMTMDMALGCSTNSMLHLPAIAHEVGFDLNVDIANEISSKTPNLCHLAPAGHTYIEDLNDAGGIYAVMNEINKLGLLKTNLITCTGKTVGENIEGCINKNPEVIRPVKNPYSQTGGIAVLKGNLAPDSCVVKRSAVVPKMLKHEGPAKVFDCEEDALEAINTGKIVAGDVVVIRYEGPKGGPGMREMLNPTSAIAGRGLGSSVALITDGRFSGASRGASIGHVSPEAAVGGNIALVEDGDMIQIDINANTINFLVSDEELARRKANWKPRKPKITTGYLARYAALVTSGNRGAILDIPKF

SEQ ID NO: 547 - DNA, 1842 bp, Pseudomonas fluorescens
atgcctgattaccgctcgaaaacatccacccatggccgcaacatggccggcgcccgcgccctgtggcgcgccacggggatgaaagatgacgacttcaagaagccgatcatcgccattgccaactccttcacccagttcgtcccggggcacgtgcacctgaaggacctgggccagctggtggctcgcgagatcgaacgcgccggtggcgtggccaaggaattcaacaccatcgccgtggacgacggcatcgccatgggccatgacggcatgctgtattcgctgccgagccgcgagatcatcgccgactccgtggagtacatggtcaacgcccactgtgccgacgccatcgtgtgcatttccaactgcgacaagatcacccccggcatgctgatggccgccctgcgcctgaacatcccggtgatcttcgtttccggcggcccgatggaagccggcaagaccaagctcgccagccatggcctggacctggtggacgccatggtcatcgccgccgactccagcgcttctgacgagaaggttgccgagtacgagcgcagcgcctgcccgacctgcggttcatgctccggcatgttcaccgccaactccatgaactgcctgaccgaagccctggggctcgccctgccgggcaacggttcgaccctggccacccacagcgatcgcgaagagctgttcctgcgggccgggcgcaccatcgtcgagctgtgccagcgctactacggcgacaacgacgagtcggtcctgccgcgcaacatcgccaacttcaaggcgttcgagaacgccatgaccctggatatcgccatgggcggttccaccaacaccatcctgcacctgctggccgccgcccaggaagccgagatcgacttcgacctgcgggacatcgatcgcctgtcgcgccacgtgccgcagctgtgcaaagtggcgccgaacatccagaagtaccacatggaagacgtgcaccgcgccggcggtatcttcagcatcctcggcgaactggcccgtggcggcctgctgcacaccgacctgcccaccgtgcacagcaagaccatggccgaaggcatcgcccagtgggacatcacccagaccagcgacgaagccgtgcatcacttcttcaaggccggcccggcgggcatcccgacccagacggcgttcagccagtcgacccgttgggacagcctcgacgatgaccgtgaaaacggctgcatccgcagtgtcgagcatgcctactcgaaagaaggcggcctggccgtgctctacggcaacatcgccctggacggctgcgtggtgaagaccgccggtgtcgacgagtcgatccatgtcttcgaaggcaacgccaagatcttcgagagccaggacagcgcggtgcgcggcatcctcgccgacgaggtgaaggaaggcgacatcgtgatcatccgttacgaaggcccgaaaggcggcccgggcatgcaggaaatgctctatccgacctcctacctgaagtccaagggcctgggcaaagcctgcgccctgctcaccgacggccgcttctccggcggcacctcgggcctgtccatcggccacgcctcgcctgaagcggcagccggtggcaccatcggcctggtgcaggacggcgacaaggtactgatcgacattcccaaccgctcgatcaacctgttggtcagcgacgaggaactggcggcccgccgtgtcgagcaggacaagaaaggctggaaaccggtggaagcacgcccgcgcaaggtgaccaccgcgctgaaggcctacgccctgctagccaccagcgccgacaagggtgcggtgcgcaacaaggccatgctcgacggcctgtga

SEQ ID NO: 548 - protein, 613 aa, Pseudomonas fluorescens
MPDYRSKTSTHGRNMAGARALWRATGMKDDDFKKPIIAIANSFTQFVPGHVHLKDLGQLVAREIERAGGVAKEFNTIAVDDGIAMGHDGMLYSLPSREIIADSVEYMVNAHCADAIVCISNCDKITPGMLMAALRLNIPVIFVSGGPMEAGKTKLASHGLDLVDAMVIAADSSASDEKVAEYERSACPTCGSCSGMFTANSMNCLTEALGLALPGNGSTLATHSDREELFLRAGRTIVELCQRYYGDNDESVLPRNIANFKAFENAMTLDIAMGGSTNTILHLLAAAQEAEIDFDLRDIDRLSRHVPQLCKVAPNIQKYHMEDVHRAGGIFSILGELARGGLLHTDLPTVHSKTMAEGIAQWDITQTSDEAVHHFFKAGPAGIPTQTAFSQSTRWDSLDDDRENGCIRSVEHAYSKEGGLAVLYGNIALDGCVVKTAGVDESIHVFEGNAKIFESQDSAVRGILADEVKEGDIVIIRYEGPKGGPGMQEMLYPTSYLKSKGLGKACALLTDGRFSGGTSGLSIGHASPEAAAGGTIGLVQDGDKVLIDIPNRSINLLVSDEELAARRVEQDKKGWKPVEARPRKVTTALKAYALLATSADKGAVRNKAMLDGL

SEQ ID NO: 549 - DNA, 1653 bp, Methanococcus maripaludis
atgataagtgataacgtcaaaaaaggagttataagatctccaaaccgagctcttttaaaagcttgcggatattcagacgaagacatggaaaaaccatttattggtgttgtaaacagcttcacagaagttgttcctggccacattcacttaaaaacattatcagaagcagttaaacatggtgtttatgcaaacggcggaacgccatttgaatttaatacaattggaatttgcgacggtattgcaatgggtcatgaaggtatgaaatactccttaccttcaagagaaatcattgcagatgctgttgaatcaatggcaagagcacacggttttgatggccttgttttaattcctacgtgtgataaaatcgttcctggaatgataatgggtgctttaagattaaatattccatttatcgtagttactgggggaccaatgcttccaggcgaattccaaggtaaaaaatgcgaacttattagtctttttgaaggggttggtgagtatcaggttggaaaaattactgaagaagaattaaaaagtattgaagaatgtgcgtgcccgggtgctggaagctgtgcagggctttacactgcaaacagtatggcatgccttacagaagctctcggactatctcttccaatgtgtgcaacaatacatgcggttgatgctcaaaaggttagaatcgctaaaaaaactggctctaaaattgttgacttggtaaaagaagatgtaaaaccaacagatatattgacaaaggaagcttttgaaaacgctattttagttgaccttgcacttggtggatcgacaaatacaacattacacattcctgcaattgcaaatgaaattgaaaataaattcataactctcgatgactttgatagattgagcaacgaagttccacacattgcatcaatcaaacccggtggagaacactacatgattgacctccataatgcaggaggtattcctgcagtattaaatgttttaaagggaaaaattagagatacaaaaacggttgacggaagaagtactttagaaattgcagaatctgtcaaatacataaattacgacgttataagaaaagtagaagctccagttcacgaaactgccggtttgagagttttaaaaggaaatcttgctccaaacggttgcgttgtaaaaatcggtgcagtaaatccaaaaatgtacaaacacgatggacctgcaaaagtttacaattcagaagatgaagcaatttctgcgatactcggtggaaaaattgtagaaggcgacgttatagtaattagatacgaaggaccatcaggtggcccgggaatgagagaaatgctctccccaacttcagcaatctgtggaatgggtcttgatgacagcgttgcattaattactgacggaagattcagtgggggaagcagaggtccatgtataggccacgtttctccagaagctgctgctggcggagtaattgctgcaattgaaaacggagatatcatcaaaattgacatgattggaaaagaaataaatgttgatttggatgaatcagtaattaaagaaagactttcaaaattggatgaatttgagcctaaaatcaaaaaaggctatttatcaagatattcaaggctcgtttcttcagctgatgaaggagcggttttaaaataa

SEQ ID NO: 550 - protein, 550 aa, Methanococcus maripaludis
MISDNVKKGVIRSPNRALLKACGYSDEDMEKPFIGVVNSFTEVVPGHIHLKTLSEAVKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKCELISLFEGVGEYQVGKITEEELKSIEECACPGAGSCAGLYTANSMACLTEALGLSLPMCATIHAVDAQKVRIAKKTGSKIVDLVKEDVKPTDILTKEAFENAILVDLALGGSTNTTLHIPAIANEIENKFITLDDFDRLSNEVPHIASIKPGGEHYMIDLHNAGGIPAVLNVLKGKIRDTKTVDGRSTLEIAESVKYINYDVIRKVEAPVHETAGLRVLKGNLAPNGCVVKIGAVNPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIGKEINVDLDESVIKERLSKLDEFEPKIKKGYLSRYSRLVSSADEGAVLK

SEQ ID NO: 551 - DNA, 1653 bp, Methanococcus aeolicus
atgataagtgataacttaaagaagggagtttccagagctccaaacagaagtttattaaaggcatgcggatatacggacgaagaaatagaaaaaccattcataggtatagtaaatagctttacagaagtagttcccgggcatattcatttaaatacattggcagaagctgcaaaaaagggagtttatgcaaacggcggaacaccttttgaatttaacactatggccgtatgtgatggtatagctatgggacatgagggaatgagatattcattaccatcaagagagataatagctgatacagtagaaagtatggcgaaagctcatggatttgatggattggtgcttattccgtcctgtgataaaattgttcctggtatgattatgggggctctaagattaaatattccattcatagtaataactggcggacctatgcaacctggggagctccacggtaaaaagtatgaccttataagtgtgtttgaaggagttggagaatataatgttggaaaaattacaaaagaggaattaatggaaattgaaacctgtgcctgtccgggagctggtagctgtgctggattatttacggcaaatagtatggcctgtttaaccgaaacacttggtttatcccttcctatgtgtgctactacacatgcaacagatgccgaaaaggtgagaattgcaaaaagaagcggtatgaaaatagttgatttggtaaaagaagatataaaaccaacagatttattaacaaaggaatcatttgaaaatgcaatattggttgatttggctttgggaggttcttcaaatacaacacttcatattccagctttggcttatgaaatagcaccagagtttataactcttgacgattttgataggttatgcgacgaggtgccacatattgcttcattaaggccggggggagaccactttataagcgatttgcatagggcaggaggtattccagctgttttaaaaatattggagcaaaaaataagggatgctaacactgtaagcggtaaatctattaaagagataataaatgaggtaaaatacattgattataatataattagaccagtggataaaccagtgcatgagaccgcaggattaaggatattaaaaggaaatatagcacctgatggctgtgttgtaaaaattagtgctgtaaatccaaagatgtataaacacgaggggcctgcacgggtatttaattcagaggaggaaaccattgacgcaatacttgggggggacattaaagaaggagatgttgttgtaataagatatgaaggtccagcaggaggtccgggaatgagagaaatgttgtctccaacttctgctatttgtggtatgggattagatgactctgttgcacttattacagatggtagatttagtgggggaagtagaggtccatgtattggacatatctcaccagaggcaatggcaggaggtccaatagccataattgaagaaggagatataattgctattgatatgatggcaaaagaaataaacttaaaaataagcgaagaagagataaaagaaagattagctaattggaaaaaaccagaaataaaagttaaaaaaggatatatatcaagatatgctaaattagtatcttcggcaaatgaaggggcagtattgaaataa

SEQ ID NO: 552 - protein, 550 aa, Methanococcus aeolicus
MISDNLKKGVSRAPNRSLLKACGYTDEEIEKPFIGIVNSFTEVVPGHIHLNTLAEAAKKGVYANGGTPFEFNTMAVCDGIAMGHEGMRYSLPSREIIADTVESMAKAHGFDGLVLIPSCDKIVPGMIMGALRLNIPFIVITGGPMQPGELHGKKYDLISVFEGVGEYNVGKITKEELMEIETCACPGAGSCAGLFTANSMACLTETLGLSLPMCATTHATDAEKVRIAKRSGMKIVDLVKEDIKPTDLLTKESFENAILVDLALGGSSNTTLHIPALAYEIAPEFITLDDFDRLCDEVPHIASLRPGGDHFISDLHRAGGIPAVLKILEQKIRDANTVSGKSIKEIINEVKYIDYNIIRPVDKPVHETAGLRILKGNIAPDGCVVKISAVNPKMYKHEGPARVFNSEEETIDAILGGDIKEGDVVVIRYEGPAGGPGMREMLSPTSAICGMGLDDSVALITDGRFSGGSRGPCIGHISPEAMAGGPIAIIEEGDIIAIDMMAKEINLKISEEEIKERLANWKKPEIKVKKGYISRYAKLVSSANEGAVLK

SEQ ID NO: 553 - DNA, 1842 bp, Vibrio fisheri
atgccaacttatcgttcagccaccaccactcacggacgtaacatggccggagcacgcgctttatggcgtgcaactggcgttaaagaagatgactttggtaaacccatcattgctgttgttaactcatttactcaatttgttccgggtcacgtacatcttaaagacatgggacaacttgttgctggcgaaatagaaaaagccggcggtatcgccaaagagtttaatactatcgccgttgatgatggtatcgctatgggtcacggtggcatgctttattctctgccatcacgcgaactcattgcagactctgttgaatacatggttaatgctcactgtgctgatgctatggtatgtatttctaactgcgacaaaattaccccaggaatgatgatggctgcaatgcgtcttaacattccagtaatttttgtgtcaggcggcccaatggaagcaggaaaaactaagctttcagatcaaataatcaaactggatcttgttgatgcaatgatccaaggtgccgatcctacggtttccgatgctcaaagtgagcagatcgagcgttcagcttgtccaacttgtggatcgtgttcaggaatgttcacggctaactcaatgaactgtttaaccgaagcgctcggtttatctcaaccaggtaatggctcaatgctcgctactcacgccgaccgcgagcagctgtttattaatgcaggtaaacgtattgttgaattaacaaagcgttattatgagcaagatgatgaatcagcacttccaagaaatattgccgaccgtgctgcatttgaaaatgccatggcacttgatatcgcaatgggtggttctagtaataccgttcttcaccttttagcttctgctcaagaaggcgaaattgatttcgatatgggtgacattgatgagatgtctcgtcgagtacctcacttgtgtaaagtcgctccatcaacgcctaaatatcatatggaagatgttcaccgagcaggtggtgtaatggctatccttggtgagttagatagagctgggcttctgaataatcaaacaaaaacggttcttggcttaaccatgcaagagcaacttgcacaatacgatattatgcaaactgaagacgaagagatccttaaattcttccgtgcaggacctgcagggatccgaacaacaaaagcattctcgcaagattgccgttgggatcgccttgatgacgaccgaaaagaagggtgtattcgaaccaaagaaaatgcctttagccaagaaggtggtctcgccgttctatctggcaatatagcggttgatggttgtattgtaaaaaccgccggcgttgatgaagaaaatctaaagttccaaggtccagccattgtttttgaaagccaagactcagcggtagaaggcattttaggtggaaaagttaaagcgggtgaagtcgttgttattcgctacgaaggtccaaagggtggtccaggtatgcaagaaatgctttacccaaccacttacttgaaatcaatgggcttaggcaaagcatgtgcgcttctaactgatggtcgattctctggtggtacatcaggcctatctataggtcacgcatctccagaagctgcaagtggtggcacaataggtttagttaacgatggtgatatcattaccatcgatatcccaagccgctcaattacgcttgatgtaccagaatcagaactgcaagctcgtcgagcgaaacaagatgaactcggttggaaacctgtgaatcgtcaacgtgaagtctcttttgcattaaaagcctatgcaagtatggcaacaagtgcagataaaggtgctgttcgtgataaatctaagttagaagggtaa

SEQ ID NO: 554 - protein, 613 aa, Vibrio fisheri
MPTYRSATTTHGRNMAGARALWRATGVKEDDFGKPIIAVVNSFTQFVPGHVHLKDMGQLVAGEIEKAGGIAKEFNTIAVDDGIAMGHGGMLYSLPSRELIADSVEYMVNAHCADAMVCISNCDKITPGMMMAAMRLNIPVIFVSGGPMEAGKTKLSDQIIKLDLVDAMIQGADPTVSDAQSEQIERSACPTCGSCSGMFTANSMNCLTEALGLSQPGNGSMLATHADREQLFINAGKRIVELTKRYYEQDDESALPRNIADRAAFENAMALDIAMGGSSNTVLHLLASAQEGEIDFDMGDIDEMSRRVPHLCKVAPSTPKYHMEDVHRAGGVMAILGELDRAGLLNNQTKTVLGLTMQEQLAQYDIMQTEDEEILKFFRAGPAGIRTTKAFSQDCRWDRLDDDRKEGCIRTKENAFSQEGGLAVLSGNIAVDGCIVKTAGVDEENLKFQGPAIVFESQDSAVEGILGGKVKAGEVVVIRYEGPKGGPGMQEMLYPTTYLKSMGLGKACALLTDGRFSGGTSGLSIGHASPEAASGGTIGLVNDGDIITIDIPSRSITLDVPESELQARRAKQDELGWKPVNRQREVSFALKAYASMATSADKGAVRDKSKLEG

SEQ ID NO: 555 - DNA, 1860 bp, Shewanella oneidensis
atgccaaagttacgatcagctaccagtacggaaggccgcaatatggcgggtgcccgtgcgctatggcgcgccaccggggtgaaagacaatgattttggtaagccgattattgcgattgccaactcctttactcagtttgttcccggccatgtgcacttaaaagatatgggctcactggtggcgagtgcgattgaagaggcgggcggtatcgccaaagaattcaatactatcgccgtcgacgatggtatcgccatgggccacggtggcatgctctacagtttgccctcgcgggagctgattgccgatagtgtggagtacatggtcaatgcccactgcgccgatgccttagtgtgtatctccaactgcgacaaaatcactcccggcatgttgatggcggcgctgcgtctcaatattcccgtggtatttgtgtcgggtgggccgatggaagcgggtaaaaccaaactgtcggacaaacttatcaagctcgatttagtcgatgccatggtggcggcggccgactcgagtgtgagcgatgaagatagcgccaaaatcgagcgcagtgcttgcccgacgtgtggttcctgttcgggcatgttcaccgccaactctatgaactgtttgaccgaagccctggggttatcgctgccgggcaacggctccatgctggcaacccatagcgatcgccgcgagctgtttttagaggcgggccggcgcgtgatggcgctgaccaagcgttattacgagcaagatgacacctcggcgctgccgcgtaatatcgcctgctttaaagcttttgagaacgccaccgcattagatatcgccatgggcggttcgtctaatactgtgttgcacttgttagcggcggcgcaggaggcggaagtcgcatttactatggacgatatcgaccgtatgtcgcgccttgtgccgcacctttgtaaagtcgccccatcgacgcctaaatatcatatggaagatgtgcaccgcgccggtggcgtgatgggcattttaggcgagcttgaccgcgccggattgctgcataccgatgtgccacacgttgccgccgatgcaggcggaaatctcaagtcggtgcttgccaagtacgatgtcatgcaaacccaagatgacaacgtaaaacaattctttatggcgggacctgcgggcatccccaccactaaagcctttagtcaagactgccgctggccatcgctggatgatgacaggcgagaagggtgtatccgcagccgcgaatttgcctttagccaagaaggcgggctggccgtgctgtcgggcaatttagctgaaaatggctgtattgttaaaacggcgggcgtggatgagtcgaatttgatttttgttggctcggctcgcgtctacgaaagccaagatgatgcggtggcgggcattttaggtggcgaagtagtggcgggcgatgtggtcgtcatccgttacgaagggccaaaaggtggtccgggtatgcaagaaatgttgtaccccaccagttacttaaaatcccgcggcttaggcaaggcctgcgcgctaatcaccgatggacgtttctctggtggaacatccggtttatccatcggccatgtgtcgcccgaggcggcggctggcggcacgattgccttgattgaaaacggcgatcgcattgaaatcgatatcccagcgcgcagtattaagctcgctgtgagcgatgccgagttagcggggcgtcgtgagaccatgttagcgcgtggtccaatggcgtggaagcctgttggtcgcgagcgttttgtatctatggcactaaaagcctacgccatgcttgccaccagtgccgataagggcgcggtgcgcgatcgcagcaagttggaggactga

SEQ ID NO: 556 - protein, 619 aa, Shewanella oneidensis
MPKLRSATSTEGRNMAGARALWRATGVKDNDFGKPIIAIANSFTQFVPGHVHLKDMGSLVASAIEEAGGIAKEFNTIAVDDGIAMGHGGMLYSLPSRELIADSVEYMVNAHCADALVCISNCDKITPGMLMAALRLNIPVVFVSGGPMEAGKTKLSDKLIKLDLVDAMVAAADSSVSDEDSAKIERSACPTCGSCSGMFTANSMNCLTEALGLSLPGNGSMLATHSDRRELFLEAGRRVMALTKRYYEQDDTSALPRNIACFKAFENATALDIAMGGSSNTVLHLLAAAQEAEVAFTMDDIDRMSRLVPHLCKVAPSTPKYHMEDVHRAGGVMGILGELDRAGLLHTDVPHVAADAGGNLKSVLAKYDVMQTQDDNVKQFFMAGPAGIPTTKAFSQDCRWPSLDDDRREGCIRSREFAFSQEGGLAVLSGNLAENGCIVKTAGVDESNLIFVGSARVYESQDDAVAGILGGEVVAGDVVVIRYEGPKGGPGMQEMLYPTSYLKSRGLGKACALITDGRFSGGTSGLSIGHVSPEAAAGGTIALIENGDRIEIDIPARSIKLAVSDAELAGRRETMLARGPMAWKPVGRERFVSMALKAYAMLATSADKGAVRDRSKLED

SEQ ID NO: 557 - DNA, 55 bp, artificial sequence
  primer
cagtaacggatccggggaggtcaaaaagataacatatggaattcaaatataacgg

SEQ ID NO: 558 - DNA, 52 bp, artificial sequence
  primer
atttgtggatccgcggccgcctataaatctgtaacgcaaccttcactagcgg

SEQ ID NO: 559 - DNA, 67 bp, artificial sequence
  primer
ataaccataaccaagtaatacatattcaaactagtatgactgacaaaaaaactcttaaagacttaag

SEQ ID NO: 560 - DNA, 87 bp, artificial sequence
  primer
ctatatcaattaatttgaattaacgcggccgcttaaccacagcaaccaggacaacattttttgccagtttcttcaggcttccaaaag

SEQ ID NO: 561 - DNA, 35 bp, artificial sequence
  primer
acgcggccgctgagatccggctgctaacaaagccc

SEQ ID NO: 562 - DNA, 81 bp, artificial sequence
  primer
atgctagctatctccttcttaaagttaaacaaaatttgcggccgctcattttttgccagtttcttcaggcttccaaaagtc

SEQ ID NO: 563 - DNA, 3748 bp, artificial sequence
  vector
gacgaaagggccttataacttacaaataacccctcgaaaacattgaaagaataacccccaagatctatattatagatcttgggggttatttgttttaatattaaagaaatgacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggagccacaatcgtcatgttacttgtctgacagactagatcattgcttagcgcaatggctggtcgcttattcatctgttcatgaccacggcttggattaaagttaacataaaatatatcaccttggcttaccattgaagttcattaccttctgactttccccaatcaagctcgtgatcccttttcccgtcatctttccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagtcaagtatatcccatgtagatacacaatgcaaatattcttactggagaaataacaccttaagtctagcaccacccgcacgcatagcggtgcttaaaccatcaagggtcaagcccttaggctctctcaaacagttatcctaatcgtgaataactgcgcttcttttgcagtataaagagagaactctttatcagacaatttaagctcaaccagcccttgcactaactattattagagttggttttagcagcaacccgaataatctgcgttaatagttagcctgtccgtatcatttcctagtcttccagccacgtctttagtcgcgttgatctcgacaaggtttagcatacctatgttgttaactgcaagcggggtcacgaacgacactcacgggaggttttactagctaagaacaggtttccagcctttagttgctttgatggttgctaaccattgaataacaaaaaaacggttgctatcaggtttctgttaagattcccgataacaaccgtttactttaagtatcaatggttgaaaaacttagcctacatgttataatagtaccaagttagatagcttgtattggtagtacttgctatcgaaaatcttatcaggttgtgctgataagtcgtgaatcctaactctgctaagttgagggttcttttttttgcgttcatttattaagttgagtacattataaccgtaatataagattaatacaacctttatcattttaacgtctcaaccagccgaataatccttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataagggcccgcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgtctcgaggaccgagcgcagcgagtcagtgagcgaggaagcggaagagcgagggcggagttgttgacagccgaggtaccatgtggtataatcccgagtgtggaattgtgagcggataacaatttcacacaggaaacagctatgaccatgattacgccaagcttggctgcaggtcgacggatccccgggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 564 - DNA, 1713 bp, Lactococcus lactis; identical to SEQ ID NO: 231

SEQ ID NO: 565 - DNA, 5323 bp, artificial sequence
  vector
gaattcagatctctcgagcccgggatcgatggtacctcgcgaaagcttggatgttgtacaggataatgtccagaaggtcgatagaaagcgtgagaaacagcgtacagacgatttagagatgtagaggtacttttatgccgagaaaactttttgcgtgtgacagtccttaaaatatacttagagcgtaagcgaaagtagtagcgacagctattaactttcggttgcaaagctctaggatttttaatggacgcagcgcatcacacgcaaaaaggaaattggaataaatgcgaaatttgagatgttaattaaagacctttttgaggtctttttttcttagatttttggggttatttaggggagaaaacataggggggtactacgacctcccccctaggtgtccattgtccattgtccaaacaaataaataaatattgggtttttaatgttaaaaggttgttttttatgttaaagtgaaaaaaacagatgttgggaggtacagtgatagttgtagatagaaaagaagagaaaaaagttgctgttactttaagacttacaacagaagaaaatgagatattaaatagaatcaaagaaaaatataatattagcaaatcagatgcaaccggtattctaataaaaaaatatgcaaaggaggaatacggtgcattttaaacaaaaaaagatagacagcactggcatgctgcctatctatgactaaattttgttaagtgtattagcaccgttattatatcatgagcgaaaatgtaataaaagaaactgaaaacaagaaaaattcaagaggacgtaattggacatttgttttatatccagaatcagcaaaagccgagtggttagagtatttaaaagagttacacattcaatttgtagtgtctccattacatgatagggatactgatacagaaggtaggatgaaaaaagagcattatcatattctagtgatgtatgagggtaataaatcttatgaacagataaaaataattaacagaagaattgaatgcgactattccgcagattgcaggaagtgtgaaaggtcttgtgagatatatgcttcacatggacgatcctaataaatttaaatatcaaaaagaagatatgatagtttatggcggtgtagatgttgatgaattattaaagaaaacaacaacagatagatataaattaattaaagaaatgattgagtttattgatgaacaaggaatcgtagaatttaagagtttaatggattatgcaatgaagtttaaatttgatgattggttcccgcttttatgtgataactcggcgtatgttattcaagaatatataaaatcaaatcggtataaatctgaccgatagattttgaatttaggtgtcacaagacactcttttttcgcaccagcgaaaactggtttaagccgactgcgcaaaagacataatcgattcacaaaaaataggcacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaatattctcttggaaccatacttaatatagaaatatcaacttctgccattaaaagtaatgccaatgagcgttttgtatttaataatcttttagcaaacccgtattccacgattaaataaatctcattagctatactatcaaaaacaattttgcgtattatatccgtacttatgttataaggtatattaccatatattttataggattggtttttaggaaatttaaactgcaatatatccttgtttaaaacttggaaattatcgtgatcaacaagtttattttctgtagttttgcataatttatggtctatttcaatggcagttacgaaattacacctctttactaattcaagggtaaaatggccttttcctgagccgatttcaaagatattatcatgttcatttaatcttatatttgtcattattttatctatattatgttttgaagtaataaagttttgactgtgttttatatttttctcgttcattataaccctctttaatttggttatatgaattttgcttattaacgattcattataaccacttattttttgtttggttgataatgaactgtgctgattacaaaaatactaaaaatgcccatattttttcctccttataaaattagtataattatagcacgagctctgataaatatgaacatgatgagtgatcgttaaatttatactgcaatcggatgcgattattgaataaaagatatgagagatttatctaatttcttttttcttgtaaaaaaagaaagttcttaaaggttttatagttttggtcgtagagcacacggtttaacgacttaattacgaagtaaataagtctagtgtgttagactttatgaaatctatatacgtttatatatatttattatccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaa

SEQ ID NO: 566 - DNA, 20 bp, artificial sequence
  ribosome binding site
atataggaggaatttttgta

SEQ ID NO: 567 - DNA, 22 bp, artificial sequence
  primer
ttgtctcgaggaccgagcgcag

SEQ ID NO: 568 - DNA, 60 bp, artificial sequence
  primer
tatagacaagcccgtcctgcagttaagcttttggatcctgttatccgctcacaattccac

SEQ ID NO: 569 - DNA, 52 bp, artificial sequence
  primer
atatggatccatataggaggaatttttgtaatggaattcaaatataacggaa

SEQ ID NO: 570 - DNA, 31 bp, artificial sequence
  primer
atatctgcagctataaatctgtaacgcaacc

SEQ ID NO: 571 - DNA, 710 bp, Lactobacillus plantarum
atgaagcgaccaattatcattgcgttagattttcccaccgccgaacgggccttagcttttttagaccaatttccggctgatttacatgtcactgtcaaaatcggcatggagttattttatgcagcgggaccgagtattgtgacggacgtgcaagctcgcggccatgcggttttcttagatttgaaactacatgatattcccaataccgtcgaatccgcaatgcgggtgatcgggcggttaggggtaacctatacgacggttcatgctgcgggtgggcacgtgatgctttcagccgccaaacgaggattggtcgcgggtgcaatggccgctggagtcactgcccccaagttattagcgattacgcagttaacttcgactaatcaagctattttgaatcaggaccagcaaatcatgggaacggttcgggcgagtgtcgtgcattatgccaaactagcacgggcgagtgactgtgatggcgtcatttgttccgcccaagaagttcaggcgattcatacggccgtcggtgctgattttctcggaattacgccgggaattcggccagcgtcggcgcagtcagatgaccagcaacgggtgatgacaccggctgccgctgctaaggctgggagcaacggtctcgtcatcgggcggccaattacgcaggctgcagaaccagttcaagcttaccgagatattatgacagaatggagtaa

SEQ ID NO: 572 - DNA, 31 bp, artificial sequence
  primer
catgaattcgtgctaagagccagattgtgga

SEQ ID NO: 573 - DNA, 50 bp, artificial sequence
  primer
catgaagaccacgcgtaggccttctagagctaaattttcacatcgtgagc

SEQ ID NO: 574 - DNA, 49 bp, artificial sequence
  primer
atttagctctagaaggcctacgcgtggtcttcatgaacttgttcaaccg

SEQ ID NO: 575 - DNA, 31 bp, artificial sequence
  primer
catctcgagccaagctcagtcacgcatttaa

SEQ ID NO: 576 - DNA, 22 bp, artificial sequence
  primer
aagcacaacgggaagcgaacat

SEQ ID NO: 577 - DNA, 23 bp, artificial sequence
  primer
atacaactatgacgctggaagcg

SEQ ID NO: 578 - DNA, 23 bp, artificial sequence
  primer
gtaggttttcccgtccttgatag

SEQ ID NO: 579 - DNA, 35 bp, artificial sequence
  primer
tataagatcttgactctggtgaacttgtcgcaacc

SEQ ID NO: 580 - DNA, 34 bp, artificial sequence
  primer
atatctcgagaataagtcatcctctcgtagtgaa

SEQ ID NO: 581 - DNA, 34 bp, artificial sequence
  primer
tatactcgagtaatcatttcatacgattaaatgt

SEQ ID NO: 582 - DNA, 32 bp, artificial sequence
  primer
atatcccggggtgagcgggtaaagtccttgcc

SEQ ID NO: 583 - DNA, 21 bp, artificial sequence
  primer
cgggcacctgcaaccgaggtc

SEQ ID NO: 584 - DNA, 22 bp, artificial sequence
  primer
ctgtttctcacgctttctatcg

SEQ ID NO: 585 - DNA, 22 bp, artificial sequence
  primer
gattttctttatcaacttcgac

SEQ ID NO: 586 - DNA, 21 bp, artificial sequence
  primer
ttggaaaacgttcttcggggc

What is claimed is:

1. A recombinant lactic acid bacterial cell comprising at least one gene encoding a heterologous polypeptide having dihydroxy-acid dehydratase activity and at least about 95% sequence identity to the polypeptide encoded by the polynucleotide sequence of SEQ ID NO:167 or SEQ ID NO:564 wherein the bacterial cell is substantially free of lactate dehydrogenase activity and wherein the heterologous polypeptide having dihydroxy-acid dehydratase activity has a specific activity of at least about 0.1 µmol min$^{-1}$ mg$^{-1}$ total soluble protein in a crude cell extract.

2. The recombinant lactic acid bacterial cell of claim 1 wherein the heterologous polypeptide having dihydroxy-acid dehydratase activity has a specific activity of at least about 0.6 µmol min$^{-1}$ mg$^{-1}$ total soluble protein in a crude cell extract.

3. The recombinant lactic acid bacterial cell of claim 1 wherein the dihydroxy-acid dehydratase polypeptide has an amino acid sequence that matches the Profile HMM of table 7 with an E value of <10$^{-5}$ wherein the polypeptide additionally comprises all three conserved cysteines, corresponding to positions 56, 129, and 201 in the amino acids sequences of the *Streptococcus mutans* DHAD enzyme corresponding to SEQ ID NO:168.

4. The recombinant lactic acid bacterial cell of claim 1 comprising a disruption in at least one endogenous gene encoding a polypeptide having lactate dehydrogenase activity.

5. The recombinant lactic acid bacterial cell of claim 4 wherein the gene encoding lactate dehydrogenase is selected from the group consisting of ldhL, ldhD, ldhL1, and ldhL2.

6. The recombinant lactic acid bacterial cell of claim 1 wherein the lactic acid bacteria is selected from the group consisting of *Lactococcus, Lactobacillus, Leuconostoc, Oenococcus, Pediococcus*, and *Streptococcus*.

7. The recombinant lactic acid bacterial cell of claim 1 wherein the bacteria produces isobutanol.

8. The recombinant lactic acid bacterial cell of claim 7 wherein the bacteria comprises an isobutanol biosynthetic pathway.

9. The recombinant lactic acid bacterial cell of claim 8 wherein the isobutanol biosynthetic pathway comprises genes encoding acetolactate synthase, acetohydroxy acid isomeroreductase, dihydroxy-acid dehydratase, branched-chain α-keto acid decarboxylase, and branched-chain alcohol dehydrogenase.

10. A method of making isobutanol comprising providing the recombinant lactic acid bacteria of claim 8 and growing the lactic acid bacteria under conditions wherein isobutanol is produced.

11. The recombinant lactic acid bacterial cell of claim 1 wherein the heterologous polypeptide having dihydroxy-acid dehydratase activity comprises cysteines at the amino acid positions corresponding to positions 57, 130, and 203 in the amino acid sequence of the *Streptococcus mutans* DHAD enzyme corresponding to SEQ ID NO:168.

12. The recombinant lactic acid bacterial cell of claim 1 wherein the heterologous polypeptide having dihydroxy-acid dehydratase activity has at least about 98% sequence identity to the polypeptide encoded by the polynucleotide sequence of SEQ ID NO:167.

13. The recombinant lactic acid bacterial cell of claim 1 wherein the heterologous polypeptide having dihydroxy-acid dehydratase activity has at least about 98% sequence identity to the polypeptide encoded by the polynucleotide sequence of SEQ ID NO:564.

14. The recombinant lactic acid bacterial cell of claim 1 wherein the heterologous polypeptide having dihydroxy-acid dehydratase activity comprises the polypeptide sequence of SEQ ID NO:168.

15. The recombinant lactic acid bacterial cell of claim 14 wherein the lactic acid bacteria is *Lactobacillus plantarum*.

16. The recombinant lactic acid bacterial cell of claim 1 wherein the bacteria comprises a valine biosynthetic pathway comprising genes encoding acetohydroxy acid reductoisomerase, dihydroxy-acid dehydratase and branched-chain amino acid aminotransferase.

17. The recombinant lactic acid bacterial cell of claim 1 wherein the bacteria comprises a leucine biosynthetic pathway comprising genes encoding acetohydroxy acid reductoisomerase, dihydroxy-acid dehydratase, 2-isopropylmalaate synthase, isopropylmalate isomerase, 3-isopropylmalate dehydrogenase and aromatic amino acid transaminase.

18. The recombinant lactic acid bacterial cell of claim 1 wherein the bacteria comprises a panthotenate biosynthetic pathway comprising genes encoding acetohydroxy acid reductoisomerase, dihydroxy-acid dehydratase, 3-methyl-2-oxobutanoate hydroxymethyltransferase, 2-dehydropantoate reductase and pantoate-beta-alanine ligase.

19. The recombinant lactic acid bacterial cell of claim 1 wherein the heterologous polypeptide having dihydroxy-acid dehydratase activity comprises the polypeptide sequence of SEQ ID NO:232.

20. The isolated recombinant lactic acid bacterial cell of claim 19 wherein the lactic acid bacteria is *Lactobacillus plantarum*.

21. The recombinant lactic acid bacterial cell of claim 14 wherein the lactic acid bacteria is *Lactobacillus plantarum*.

* * * * *